US012637514B2

(12) United States Patent
Yu et al.

(10) Patent No.: US 12,637,514 B2
(45) Date of Patent: May 26, 2026

(54) ANTIBODIES THAT INHIBIT ERYTHROPOIETIN RECEPTOR ACTIVATION AND METHODS OF USE THEREOF TO TREAT CANCER

(71) Applicants: ImmunEdge, Inc., Atherton, CA (US); The Board of Trustees of the Leland Stanford Junior University, Stanford, CA (US)

(72) Inventors: Bo Yu, Mountain View, CA (US); Edgar G. Engleman, Atherton, CA (US); Xiangyue Zhang, Sunnyvale, CA (US); David Kung-Chun Chiu, Mountain View, CA (US)

(73) Assignees: ImmunEdge, Inc., Redwood City, CA (US); The Board of Trustees of the Leland Stanford University, Stanford, CA (US)

( * ) Notice: Subject to any disclaimer, the term of this patent is extended or adjusted under 35 U.S.C. 154(b) by 0 days.

(21) Appl. No.: 18/844,737

(22) PCT Filed: Mar. 8, 2023

(86) PCT No.: PCT/US2023/063997
§ 371 (c)(1),
(2) Date: Sep. 6, 2024

(87) PCT Pub. No.: WO2023/172990
PCT Pub. Date: Sep. 14, 2023

(65) Prior Publication Data
US 2025/0129147 A1      Apr. 24, 2025

Related U.S. Application Data

(60) Provisional application No. 63/317,943, filed on Mar. 8, 2022.

(51) Int. Cl.
| | |
|---|---|
| *C07K 16/28* | (2006.01) |
| *A61K 39/00* | (2006.01) |
| *A61P 37/02* | (2006.01) |
| *A61P 37/06* | (2006.01) |
| *C07K 14/505* | (2006.01) |
| *C07K 16/22* | (2006.01) |
| *C12N 15/113* | (2010.01) |

(52) U.S. Cl.
CPC .......... *C07K 16/2866* (2013.01); *A61P 37/02* (2018.01); *A61P 37/06* (2018.01); *C07K 14/505* (2013.01); *C07K 16/22* (2013.01); *C12N 15/113* (2013.01); *A61K 2039/505* (2013.01); *C07K 2317/31* (2013.01); *C07K 2317/565* (2013.01); *C07K 2317/70* (2013.01); *C07K 2317/76* (2013.01); *C07K 2319/30* (2013.01); *C07K 2319/31* (2013.01); *C12N 2310/14* (2013.01)

(58) Field of Classification Search
CPC .......................... C07K 16/2866; C07K 16/22; C07K 16/2863; C07K 16/2818; C07K 14/505; C07K 2319/30; C07K 2319/31; A61P 37/02; A61P 37/06; A61P 31/14; A61P 31/00; A61P 7/06; A61P 35/00; C12N 15/113; C12N 2310/14; A61K 2039/505; A61K 2039/507; A61K 39/39541; A61K 2300/00; A61K 31/7088
See application file for complete search history.

(56) References Cited

U.S. PATENT DOCUMENTS

| | | | |
|---|---|---|---|
| 4,816,567 A | 3/1989 | Cabilly et al. |
| 4,956,778 A | 9/1990 | Naito |
| 5,091,513 A | 2/1992 | Huston et al. |
| 5,132,405 A | 7/1992 | Huston et al. |
| 5,223,409 A | 6/1993 | Ladner et al. |
| 5,225,539 A | 7/1993 | Winter |
| 5,545,806 A | 8/1996 | Lonberg et al. |
| 5,545,807 A | 8/1996 | Surani et al. |
| 5,569,825 A | 10/1996 | Lonberg et al. |
| 5,585,089 A | 12/1996 | Queen et al. |
| 5,624,821 A | 4/1997 | Winter et al. |
| 5,625,126 A | 4/1997 | Lonberg et al. |
| 5,633,425 A | 5/1997 | Lonberg et al. |
| 5,648,260 A | 7/1997 | Winter et al. |
| 5,661,016 A | 8/1997 | Lonberg et al. |
| 5,733,743 A | 3/1998 | Johnson et al. |
| 5,750,373 A | 5/1998 | Garrard et al. |
| 5,849,500 A | 12/1998 | Breitling et al. |

(Continued)

FOREIGN PATENT DOCUMENTS

| | | |
|---|---|---|
| EP | 0125023 A1 | 11/1984 |
| EP | 0171496 A2 | 2/1986 |

(Continued)

OTHER PUBLICATIONS

Udupa KB (Dec. 14, 2006) World J Gastroenterol. 12(46):7460-7462 (doi: 10.3748/wjg.v12.i46.7460; http://www.wjgnet.com/1007-9327/12/7460.asp).*

(Continued)

*Primary Examiner* — Robert S Landsman

(74) *Attorney, Agent, or Firm* — Wilson Sonsini Goodrich & Rosati

(57) ABSTRACT

The present disclosure provides anti-EPOR antibodies, anti-EPO antibodies, and fragments thereof that specifically bind to the hetero-EPOR or homo-EPOR or EPO with high affinity. The anti-EPOR antibodies, anti-EPO antibodies, and/or engineered EPOs can be used to treat patients.

28 Claims, 48 Drawing Sheets
Specification includes a Sequence Listing.

(56) References Cited

U.S. PATENT DOCUMENTS

| | | | |
|---|---|---|---|
| 6,180,370 B1 | 1/2001 | Queen et al. | |
| 6,702,705 B1 | 3/2004 | Von Borstel et al. | |
| 7,053,050 B2 * | 5/2006 | Yasuda | A61P 35/00 514/19.3 |
| 7,501,121 B2 | 3/2009 | Tchistiakova et al. | |
| 2003/0166871 A1 | 9/2003 | Barbas et al. | |
| 2004/0009530 A1 | 1/2004 | Wilson et al. | |
| 2005/0037421 A1 | 2/2005 | Honda et al. | |
| 2007/0269379 A1 | 11/2007 | Mitragotri et al. | |
| 2013/0150625 A1 | 6/2013 | Budzik et al. | |
| 2023/0310539 A1 | 10/2023 | Kouji et al. | |

FOREIGN PATENT DOCUMENTS

| | | | |
|---|---|---|---|
| EP | 0173494 A2 | 3/1986 | |
| EP | 0184187 A2 | 6/1986 | |
| EP | 0388151 A1 | 9/1990 | |
| EP | 0519596 A1 | 12/1992 | |
| WO | WO-8601533 A1 | 3/1986 | |
| WO | WO-8702671 A1 | 5/1987 | |
| WO | WO-9002809 A1 | 3/1990 | |
| WO | WO-9100906 A1 | 1/1991 | |
| WO | WO-9109967 A1 | 7/1991 | |
| WO | WO-9109968 A1 | 7/1991 | |
| WO | WO-9110741 A1 | 7/1991 | |
| WO | WO-9117271 A1 | 11/1991 | |
| WO | WO-9201047 A1 | 1/1992 | |
| WO | WO-9203917 A1 | 3/1992 | |
| WO | WO-9203918 A1 | 3/1992 | |
| WO | WO-9209690 A2 | 6/1992 | |
| WO | WO-9211383 A1 | 7/1992 | |
| WO | WO-9215679 A1 | 9/1992 | |
| WO | WO-9218619 A1 | 10/1992 | |
| WO | WO-9220791 A1 | 11/1992 | |
| WO | WO-9301288 A1 | 1/1993 | |
| WO | WO-9404678 A1 | 3/1994 | |
| WO | WO-9856915 A2 | 12/1998 | |
| WO | WO-9945110 A1 | 9/1999 | |
| WO | WO-9958572 A1 | 11/1999 | |
| WO | WO-0034784 A1 | 6/2000 | |
| WO | WO-0060070 A1 | 10/2000 | |
| WO | WO-0061637 A1 | 10/2000 | |
| WO | WO-0164942 A1 | 9/2001 | |
| WO | WO-2022025204 A1 | 2/2022 | |
| WO | WO-2023172990 A2 | 9/2023 | |

OTHER PUBLICATIONS

Paul, WE (1993) Fundamental Immunology, 3rd ed. Raven Press, NY, Chap. 9, pp. 292-295.*

Rudikoff, S et al. (1982) Proc. Natl. Acad. Sci. USA, 79:1979-1983 (doi: 10.1073/pnas.79.6.1979).*

Colman, PM (1994) Research in Immunology, Elsevier, NY, 145(1):33-36.*

Bendig M. M. (1995) Methods: A Companion to Methods in Enzymology, 8:83-93.*

MacCallum et al. (Oct. 11, 1996) J. Mol. Biol., 262(5):732-745. (doi: 10.1006/jmbi.1996.0548).*

Casset et al.(2003) Biochemical and Biophysical Research Communications, 307:198-205. (doi: 10.1016/S0006-291X(03)01131-8).*

Chen et al. (1995) EMBO J., 14(12):2784-2794. (doi: 10.1002/j.1460-2075.1995.tb07278.x).*

Al-Lazikani, Bissan. et al. Standard Conformations for the Canonical Structures of Immunoglobulins. Journal of Molecular Biology 273(4):927-948 (1997).

Alnaeeli, M. et al. Erythropoietin and obesity-induced white adipose tissue inflammation: redefining the boundaries of the immunometabolism territory. Adipocyte 4(2):153-157 (2015).

Alnaeeli, M. et al. Erythropoietin signaling: a novel regulator of white adipose tissue inflammation during diet-induced obesity. Diabetes 63(7):2415-2431 (2014).

Altschul, Stephen F. et al. Basic Local Alignment Search Tool. Journal of Molecular Biology 215(3):403-410 (1990).

Annese, T. et al. Erythropoietin in tumor angiogenesis. Experimental Cell Research 374(2):266-273 (2019).

Bajorath, J. et al. Conformational similarity and systematic displacement of complementarity determining region loops in high resolution antibody X-ray structures. Journal of Biological Chemistry 270(38):22081-22084 (1995).

Barbas, Carlos F. et al. Assembly of Combinatorial Antibody Libraries on Phage Surfaces: The Gene III Site. Proceedings of the National Academy of Sciences of the United States of America 88(18):7978-7982 (1991).

Basha, Genc. et al. Influence of cationic lipid composition on gene silencing properties of lipid nanoparticle formulations of siRNA in antigen-presenting cells. Molecular Therapy 19(12):2186-2200 (2011).

Better, Marc. et al. *Escherichia coli* Secretion of an Active Chimeric Antibody Fragment. Science 240(4855):1041-1043 (1988).

Bhoopalan, Senthil Velan. et al. Erythropoietin regulation of red blood cell production: from bench to bedside and back. F1000Research 9:F1000-Faculty, 1-17 (2020).

Binz, H Kaspar. et al. Engineering novel binding proteins from nonimmunoglobulin domains. Nat Biotechnol 23(10):1257-1268 (2005).

Bird, Robert E. et al. Single-chain Antigen-binding Proteins. Science 242(4877):423-426 (1988).

Boerner, Paula. et al. Production Of Antigen-Specific Human Monoclonal Antibodies From In Vitro-primed Human Splenocytes. Journal of Immunology 147(1):86-95 (1991).

Bonifaz, Laura. et al. Efficient targeting of protein antigen to the dendritic cell receptor DEC-205 in the steady state leads to antigen presentation on major histocompatibility complex class I products and peripheral CD8+ T cell tolerance. J Exp Med 196(12):1627-1638 (2002).

Brines, M. et al. Erythropoietin mediates tissue protection through an erythropoietin and common beta-subunit heteroreceptor. Proceedings of the National Academy of Sciences 101(41):14907-14912 (2004).

Brines, Michael, and Anthony Cerami. Emerging biological roles for erythropoietin in the nervous system. Nat Rev Neurosci 6:484-494 (2005).

Broxmeyer, H. E. Erythropoietin: multiple targets, actions, and modifying influences for biological and clinical consideration. The Journal of Experimental Medicine 210(2):205-208 (2013).

Bruggemann, Marianne. et al. Designer Mice: The Production of Human Antibody Repertoires in Transgenic Animals. The Year in immunology 7:33-40 (1993).

Bruggemann, Marianne. et al. Human antibody production in transgenic mice: expression from 100kb of the human IgH locus. European Journal of Immunology 21(5):1323-1326 (1991).

Cantarelli, Chiara. et al. Erythropoietin, a multifaceted protein with innate and adaptive immune modulatory activity. Am J Transplant 19(9):2407-2414 (2019).

Carter, Paul. et al. Humanization of an Anti-p185HER2 Antibody for Human Cancer Therapy. PNAS USA 89(10):4285-4289 (1992).

Chothia, Cyrus, and Arthur M. Lesk. Canonical Structures for the Hypervariable Regions of Immunoglobulins. Journal of Molecular Biology 196(4):901-917 (1987).

Chothia, Cyrus. et al. Conformations of Immunoglobulin Hypervariable Regions. Nature 342(6252):877-883 (1989).

Chothia, Cyrus. et al. Structural Repertoire of the Human VH Segments. Journal of Molecular Biology 227(3):799-817 (1992).

Cifuentes-Rius, Anna. et al. Inducing immune tolerance with dendritic cell-targeting nanomedicines. Nat Nanotechnol 16(1):37-46 (2021).

Clackson, Tim. et al. Making Antibody Fragments using Phage Display Libraries. Nature 352(6336):624-628 (1991).

ClinicalTrials.gov Identifier: NCT01004822. A Safety, Tolerability, And Pharmacokinetic Trial With CVX-241 In Patients With Advanced Solid Tumors, Record created Oct. 28, 2009. pp. 1-17. [retrieved on Jul. 12, 2024] Available at URL: https://clinicaltrials.gov/study/NCT01004822?cond=NCT01004822&rank=1.

Co, M S. et al. Humanized antibodies for antiviral therapy. Proc. Natl.Acad. Sci. USA 88(7):2869-2873 (1992).

(56) References Cited

OTHER PUBLICATIONS

Co, M.S. et al., Chimeric and Humanized antibodies with specificity for the CD33 antigen. The Journal Immunology 148(4):1149-1154 (1992).

Colcher, David. et al. Single-Chain Antibodies in Pancreatic Cancer. Annals of the New York Academy of Sciences 880:263-280 (1999).

Cole, S.P.C. et al. The EBV-Hybridoma Technique and its Application to Human Lung Cancer. Monoclonal Antibodies and Cancer Therapy 27:77-96 (1985).

Feng, D F, and R F Doolittle. Progressive Sequence Alignment as a Prerequisite to Correct Phylogenetic Trees. Journal of Molecular Evolution 25(4):351-360 (1987).

Fuchs, Patrick. et al. Targeting recombinant antibodies to the surface of *Escherichia coli*: fusion to a peptidoglycan associated lipoprotein. Biotechnology 9(12):1369-1372 (1991).

Garrard, Lisa. et al. FAB Assembly And Enrichment In A Monovalent Phage Display System. Biotechnology 9(12):1373-1377 (1991).

Gram, Hermann. et al. In Vitro Selection and Affinity Maturation of Antibodies From a Naive Combinatorial Immunoglobulin Library. Proceedings of the National Academy of Sciences of the United States of America 89(8):3576-3580 (1992).

Green, L.L. et al. Antigen-specific human monoclonal antibodies from mice engineered with human Ig heavy and light chain YACS. Nature Genet 7:13-21 (1994).

Griffiths, Andrew D. et al. Human anti-self antibodies with high specificity from phage display libraries. The EMBO Journal 12(2):725-734 (1993).

Hawkins, Robert E. et al. Selection of Phage Antibodies By Binding Affinity Mimicking Affinity Matruation. Journal of Molecular Biology 226(3):889-896 (1992).

Hay, Beverly N. et al. Bacteriophage Cloning and *Escherichia coli* Expression of a Human IgM Fab. Human Antibodies and Hybridomas 3(2):81-85 (1992).

Henikoff, Seteven, and J G Henikoff. Amino acid substitution matrices from protein blocks. Proc Natl Acad Sci U S A 89(22):10915-10919 (1992).

Hey, Thomas. et al. Artificial, Non-Antibody Binding Proteins For Pharmaceutical And Industrial Applications. Trends in Biotechnology. 23(10):514-522 (2005).

Heyes, James. et al. Cationic Lipid Saturation Influences Intracellular Delivery of Encapsulated Nucleic Acids. Journal of Controlled Release 107(2):276-287 (2005).

Higgins, Desmond G, and Paul M. Sharp. Fast and Sensitive Multiple Sequence Alignments on a Microcomputer. Bioinformatics 5(2):151-153 (1989).

Hoogenboom, Hennie R, and Greg Winter. By-Passing Immunisation: Human Antibodies From Synthetic Repertoires Of Germline VH Gene Segments Rearranged In Vitro. Journal of Molecular Biology 227(2):381-388 (1992).

Hoogenboom, Hennie R. et al. Multi-Subunit Proteins on the Surface of Filamentous Phage: Methodologies for Displaying Antibody (Fab) Heavy and Light Chains. Nucleic Acids Research 19(15):4133-4137 (1991).

Hou, Xucheng. et al. Lipid Nanoparticles for mRNA Delivery. Nature Reviews Materials 6:1078-1094 (2021).

Huse, William D. et al. Generation Of A Large Combinatorial Library Of The Immunoglobulin Repertoire In Phage Lambda. Science 246(4935):1275-1281 (1989).

Huston, James S. et al. Protein Engineering of Antibody Binding Sites: Recovery of Specific Activity in an Anti-digoxin Single-chain Fv Analogue Produced in *Escherichia coli*. PNAS USA 85(16):5879-5883 (1988).

Jang, Hochung. et al. Nanoparticles targeting innate immune cells in tumor microenvironment. International journal of molecular sciences 22(18):10009, 1-20 (2021).

Jayaraman, Muthusamy et al. Maximizing the potency of siRNA lipid nanoparticles for hepatic gene silencing in vivo. Angew Chem Int Ed Engl 51(34):8529-8533 (2012).

Jones, Peter T. et al. Replacing The Complementarity-determining Regions In A Human Antibody With Those From A Mouse. Nature 321(6069):522-525 (1986).

Kabat, Elvin A. et al. Sequences of Proteins of Immunological Interest, 5th Edition. U.S. Department of Health and Human Services NIH Publication No. 91-3242 (1991).

Karlin, Samuel. et al. Applications and Statistics for Multiple High-scoring Segments in Molecular Sequences. PNAS USA 90(12):5873-5877 (1993).

Kostelny, S A. et al. Formation of a Bispecific Antibody by the Use of Leucine Zippers. Journal of Immunology 148(5):1547-1553 (1992).

Lee et al.: β Common Receptor Mediates Erythropoietin-Conferred Protection on OxLDL-Induced Lipid Accumulation and Inflammation in Macrophages. Mediators Inflamm 2015: 439759; pp. 1-13 (2015).

Lefranc, Marie-Paule. IMGT, the international ImMunoGeneTics database. Nucleic Acids Research 29(1):207-209 (2001).

Liu, Alvin. et al. Chimeric Mouse-human IgG1 Antibody that can Mediate Lysis of Cancer Cells. Proceedings of the National Academy of Sciences of the United States of America 84(10):3439-3443 (1987).

Liu, Alvin Y. et al. Production of a Mouse-human Chimeric Monoclonal Antibody to CD20 With Potent Fc-dependent Biologic Activity. Journal of Immunology 139(10):3521-3526 (1987).

Lonberg, Nils. et al. Antigen-Specific Human Antibodies From Mice Comprising Four Distinct Genetic Modifications. Nature 368(6474):856-859 (1994).

Luo, B. et al. Erythropoeitin signaling in macrophages promotes dying cell clearance and immune tolerance. Immunity Article 44(2):287-302 (2016).

Maccallum, Robert M. et al. Antibody-Antigen Interactions: Contact Analysis And Binding Site Topography. Journal of Molecular Biology 262(5):732-745 (1996).

Maier, Martin A. et al. Biodegradable lipids enabling rapidly eliminating lipid nanoparticles for systemic delivery of RNAi therapeutics. Mol Ther 21(8):1570-1578 (2013).

Marks, J D. et al. By-passing immunization. Human antibodies from V-gene libraries displayed on phage. J Mol Biol. 222(3):581-597 (1991).

Marks, James. et al. By-passing Immunization: Building High Affinity Human Antibodies by Chain Shuffling. Bio/Technology 10(7):779-783 (1992).

Martin, A C. et al. Modeling antibody hypervariable loops: a combined algorithm. PNAS USA 86(23):9268-9272 (1989).

Martin, A. C. et al. Molecular modeling of antibody combining sites. Methods Enzymol 203:121-153 (1991).

Martin, Franck. et al. The affinity-selection of a minibody polypeptide inhibitor of human interleukin-6. The EMBO Journal 13(22):5303-5309 (1994).

McConnell, Stephen J. et al. Tendamistat as a Scaffold for Conformationally Constrained Phage Peptide Libraries. Journal of Molecular Biology 250(4):460-470 (1995).

Milletti, Francesca. et al. Cell-penetrating peptides: classes, origin, and current landscape. Drug Discovery Today 17(15-16):850-860 (2012).

Morrison, Sherie L et al. Chimeric human antibody molecules: mouse antigen-binding domains with human constant region domains. Pnas USA 81(21):6851-6855 (1984).

Muyldermans, Serge et al. Sequence And Structure Of Vh Domain From Naturally Occurring Camel Heavy Chain Immunoglobulins Lacking Light Chains. Protein Engineering 7(9): 1129-1135 (1994).

Nairz, M et al. Erythropoietin contrastingly affects bacterial infection and experimental colitis by inhibiting nuclear factor-kb-inducible immune pathways. Immunity Article 34(1):61-74 (2011).

Needleman, Saul B, and Christian D. Wunsch. A General Method Applicable to the Search for Similarities in the Amino Acid Sequence of Two Proteins. Journal of Molecular Biology 48(3):443- 453 (1970).

Nishimura, Yushi et al. Recombinant Human-Mouse Chimeric Monoclonal Antibody Specific for Common Acute Lymphocytic Leukemia Antigen. Cancer Research 47(4):999-1005 (1987).

(56)         References Cited

OTHER PUBLICATIONS

PCT/US2023/063997 International Preliminary Report on Patentability dated Sep. 19, 2024.

PCT/US2023/063997 International Search Report and Written Opinion dated Sep. 20, 2023.

Pearson, William R, and David J. Lipman. Improved Tools for Biological Sequence Comparison. Proceedings of the National Academy of Sciences 85(8):2444-2448 (1988).

Pedersen, Jan et al. Antibody modeling: beyond homology. Immunomethods 1(2):126-136 (1992).

Peng, Bo. et al. Erythropoietin and its derivatives: from tissue protection to immune regulation. Cell death and disease 11(2):79, 1-12 (2020).

Prausnitz, Mark R. et al. Transdermal drug delivery. Nature Biotechnology 26(11):1261-1268 (2008).

Rader, C. et al. A phage display approach for rapid antibody humanization: Designed combinatorial V gene libraries. PNAS USA 95(15):8910-8915 (1998).

Rader, C. et al. The rabbit antibody repertoire as a novel source for the generation of therapeutic human antibodies. Journal of Biological Chemistry 275(18):13668-13676 (2000).

Reiter, Yoram. et al. Antibody Engineering of Recombinant Fv Immunotoxins for Improved Targeting of Cancer: Disulfide-stabilized Fv Immunotoxins. Clin Cancer Res 2(2):245-252 (1996).

Rohaan, Maartje W. et al. Adoptive cellular therapies: the current landscape. Virchows Archiv 474(4):449-461 (2019). Published Online Nov. 23, 2018.

Routledge, E.G. et al. A humanized monovalent CD3 antibody which can activate homologous complement. Eur. J. Immunol. 21(11):2717-2725 (1991).

Ruan, Renquan. et al. Recent advances in peptides for enhancing transdermal macromolecular drug delivery. Therapeutic Delivery 7(2):89-100 (2016).

Ruiz, Manuel. et al. IMGT, the international ImMunoGeneTics database. Nucleic acids research 28(1):219-221 (2000).

Semenza, Gregg L. Involvement of oxygen-sensing pathways in physiologic and pathologic erythropoiesis. Blood, The Journal of the American Society of Hematology 114(10):2015-2019 (2009).

Semple, Sean C. et al. Rational design of cationic lipids for siRNA delivery. Nature biotechnology 28(2):172-176 (2010).

Shaw, Denise R. et al. Mouse/Human Chimeric Antibodies to a Tumor-Associated Antigen: Biologic Activity of the Four Human IgG Subclasses. Journal of the National Cancer Institute 80(19):1553-1559 (1988).

Sheets, Michael D. et al. Efficient Construction Of A Large Nonimmune Phage Antibody Library: The Production Of High-affinity Human Single-chain Antibodies To Protein Antigens. Proceedings of the National Academy of Sciences of the United States of America 95(11):6157-6162 (1998).

Smith, Temple F, and Michael S. Waterman. Comparison of Biosequences. Advances in Applied Mathematics 2(4):482-489 (1981).

Songsivilai, S et al. Bispecific antibody: a tool for diagnosis and treatment of disease. Clinical and Experimental Immunology vol. 79(3):315-321 (1990).

Spiess, Christoph. et al. Alternative Molecular Formats and Therapeutic Applications for Bispecific Antibodies. Molecular Immunology 67(2):95-106 (2015).

Steinberger, P. et al. Generation and characterization of a recombinant human ccr5-specific antibody. Protein Structure and Folding 275(46):36073-36078 (2000).

Su, Kuo-Hui. et al. Beta Common receptor integrates the erythropoietin signaling in activation of endothelial nitric oxide synthase. Journal of cellular physiology 226(12):3330-3339 (2011).

Sun, Lee K. et al. Chimeric Antibody With Human Constant Regions and Mouse Variable Regions Directed Against Carcinoma-Associated Antigen 17-1A. Proceedings of the National Academy of Sciences of the United States of America 84(1):214-218 (1987).

Suresh, Sukanya. et al. The many facets of erythropoietin physiologic and metabolic response. Frontiers in physiology 10:1534, 1-20 (2020).

Teng, R. et al. Acute erythropoietin cardioprotection is mediated by endothelial response. Basic Research in Cardiology 106(3):343-354 (2011).

Thompson, J D. et al. Clustal W: improving the sensitivity of progressive multiple sequence alignment through sequence weighting, position-specific gap penalties and weight matrix choice. Nucleic Acids Research 22(22):4673-4680 (1994).

Tramontano, Anna et al. Framework Residue 71 Is a Major Determinant of the Position and Conformation of the Second Hypervariable Region in the VH Domains of Immunoglobulins. Journal of Molecular Biology 215(1):175-182 (1990).

Tramontano, Anna. et al. The Making of the Minibody: an Engineered Beta-Protein for the Display of Conformationally Constrained Peptides. Journal of Molecular Recognition 7(1):9-24 (1994).

Tuaillon, Nadine et al. Human Immunoglobulin Heavy-Chain Minilocus Recombination in Transgenic Mice: Gene-Segment Use in Mu and Gamma Transcripts. Proceedings of the National Academy of Sciences of the United States of America 90(8):3720-3724 (1993).

Vaughan, Tristan. et al. Human Antibodies With Sub-Nanomolar Affinities Isolated From A Large Non-immunized Phage Display Library. Nature Biotechnology 14(3):309-314 (1996).

Wang, L. et al. Treatment of stroke with erythropoietin enhances neurogenesis and angiogenesis and improves neurological function in rats. Stroke 35(7):1732-1737 (2004).

Wei et al.: Distinct Cellular Mechanisms Underlie Anti-CTLA-4 and Anti-PD-1 Checkpoint Blockade. Cell 170:1120-1133 (2017).

Whittle, N. et al. Expression in COS cells of a mouse-human chimaeric B72.3 Antibody. Protein Engineering 1(6):499-505 (1987).

Wood, Clive R. et al. The Synthesis and in Vivo Assembly of Functional Antibodies in Yeast. Nature 314(6010):446-449 (1985).

Abramson, J. et al. The emerging family of RORγt+ antigen-presenting cells. Nature Reviews Immunology 24(1):64-77 (2024).

Aizarani, Nadim. et al. A human liver cell atlas reveals heterogeneity and epithelial progenitors. Nature 572(7768):199-204 (2019).

Akagbosu, Blossom. et al. Novel antigen-presenting cell imparts Treg-dependent tolerance to gut microbiota. Nature 610(7933):752-760 (2022).

Alaluf, Emmanuelle. et al. Heme oxygenase-1 orchestrates the immunosuppressive program of tumor-associated macrophages. JCI Insight 5(11):e133929, 1-16 (2020).

Anders, Simon. et al. HTSeq—a Python Framework to Work With High-throughput Sequencing Data. Bioinformatics 31(2):166-169 (2015). Published Online Sep. 25, 2014.

Anderson III, David A. et al. Genetic Models of Human and Mouse Dendritic Cell Development and Function. Nature Reviews Immunology 21(2):101-115 (2021).

Anderson III, David A. et al. Models of dendritic cell development correlate ontogeny with function. Advances in Immunology 143:99-119 (2019).

Arcasoy, Murat O. et al. Erythropoietin and erythropoietin receptor expression in human prostate cancer. Modern Pathology 18(3):421-430 (2005).

Ardouin, Laurence. et al. Broad and largely concordant molecular changes characterize tolerogenic and immunogenic dendritic cell maturation in thymus and periphery. Immunity 45(2):305-318 (2016).

Ayala, Mariela A. Moreno. et al. CXCR3 Expression in Regulatory T Cells Drives Interactions With Type I Dendritic Cells in Tumors to Restrict CD8+ T Cell Antitumor Immunity. Immunity 56(7):1613-1630 (2023).

Azukizawa, Hiroaki. et al. Steady State Migratory RelB+ Langerin+ Dermal Dendritic Cells Mediate Peripheral Induction of Antigen-specific Cd4+ Cd25+ Foxp3+ Regulatory T Cells. European Journal of Immunology 41(5):1420-1434 (2011).

Badoual et al. PD-1-expressing tumor-infiltrating T cells are a favorable prognostic biomarker in HPV-associated head and neck cancer. Cancer Res. 73(1):128-138 (2013).

Balan, Sreekumar. et al. Unexplored horizons of cDC1 in immunity and tolerance. Advances in Immunology 148:49-91 (2020).

(56)         References Cited

OTHER PUBLICATIONS

Beattie, Lynette. et al. Bone marrow-derived and resident liver macrophages display unique transcriptomic signatures but similar biological functions. Journal of hepatology 65(4):758-768 (2016).

Bezzi, Marco. et al. Diverse genetic-driven immune landscapes dictate tumor progression through distinct mechanisms. Nature medicine 24(2):165-175 (2018).

Billingham, R. E. et al. Actively acquired tolerance of foreign cells. Nature 172(4379):603-606 (1953).

Bin, Sofia. et al. Endogenous Erythropoietin Has Immunoregulatory Functions That Limit the Expression of Autoimmune Kidney Disease in Mice. Frontiers in Immunology 14:1195662, 1-9 (2023).

Binnewies, Mikhail. et al. Unleashing Type-2 Dendritic Cells to Drive Protective Antitumor CD4+ T Cell Immunity. Cell 177(3):556-571 (2019).

Blagosklonny, Mikhail V. et al. p53 inhibits hypoxia-inducible factor-stimulated transcription. Journal of Biological Chemistry 273(20):11995-11998 (1998).

Blanco, Tomas. et al. Conventional type I migratory CD103+ dendritic cells are required for corneal allograft survival. Mucosal immunology 16(5):711-726 (2023).

Bluestone, Jeffrey A. et al. Tolerance in the age of immunotherapy. The New England Journal of Medicine 383(12):1156-1166 (2020).

Bod, Lloyd. et al. B-cell-specific Checkpoint Molecules That Regulate Anti-tumour Immunity. Nature 619(7969):348-356 (2023).

Bolger, Anthony M. et al. Trimmomatic: A Flexible Trimmer For Illumina Sequence Data. Bioinformatics 30(15):2114-2120 (2014).

Bonaventura et al., Cold tumors: a therapeutic challenge for immunotherapy. Frontiers in Immunology 10:168 (2019).

Bories, Gael F. P. et al. Macrophage metabolic adaptation to heme detoxification involves CO-dependent activation of the pentose phosphate pathway. Blood 136(13):1535-1548 (2020).

Borst, Jannie. et al. CD4+ T Cell Help in Cancer Immunology and Immunotherapy. Nature Reviews Immunology 18(10):635-647 (2018).

Bosteels, Victor, and Sophie Janssens. Striking a Balance: New Perspectives on Homeostatic Dendritic Cell Maturation. Nature Reviews Immunology 25(2):125-140 (2025). Published Online Sep. 17, 2024.

Bosteels, Victor. et al. LXR signaling controls homeostatic dendritic cell maturation. Science Immunology 8(83):eadd3955 (2023).

Bottcher, Jan P., and Caetano Reis e Sousa. The role of type 1 conventional dendritic cells in cancer immunity. Trends in Cancer 4(11):784-792 (2018).

Bourque, Jessica. et al. Immunomodulatory bonds of the partnership between dendritic cells and T cells. Critical reviews in immunology 38(5):379-401 (2018).

Brown, Hailey. et al. Lymph Node Sharing Between Pancreas, Gut, and Liver Leads to Immune Crosstalk and Regulation of Pancreatic Autoimmunity. Immunity 56(9):2070-2085 (2023).

Broz, Miranda L. et al. Dissecting the tumor myeloid compartment reveals rare activating antigen-presenting cells critical for T cell immunity. Cancer cell 26(5):638-652 (2014).

Campos Canesso, Maria Cecilia. et al. Identification of antigen-presenting cell-T cell interactions driving immune responses to food. Science 387(6739):eado5088, 1-28 (2025).

Casanova-Acebes, Maria. et al. Tissue-resident macrophages provide a pro-tumorigenic niche to early NSCLC cells. Nature 595(7868):578-584 (2021).

Cheng, Sijin. et al. A pan-cancer single-cell transcriptional atlas of tumor infiltrating myeloid cells. Cell 184(3):792-809 (2021).

Chiu, David Kung-Chun. et al. Hepatocellular carcinoma cells up-regulate PVRL1, stabilizing PVR and inhibiting the cytotoxic T-cell response via TIGIT to mediate tumor resistance to PD1 inhibitors in mice. Gastroenterology 159(2):609-623 (2020).

Chow, Andrew. et al. Tim-4+ cavity-resident macrophages impair anti-tumor CD8+ T cell immunity. Cancer Cell 39(7):973-988.e9 (2021).

Consonni, Francesca Maria. et al. Heme catabolism by tumor-associated macrophages controls metastasis formation. Nature immunology 22(5): 595-606 (2021).

Crozat, Karine, et al., The XC Chemokine Receptor 1 is a Conserved Selective Marker of Mammalian Cells Homologous to Mouse CD8a+ Dendritic Cells. Journal of Experimental Medicine 207(6):1283-1292 (2010).

Cruz De Casas, Paulina. et al. Same Yet Different—how Lymph Node Heterogeneity Affects Immune Responses. Nature Reviews Immunology 24(5):358-374 (2024).

De Simone, Giorgia. et al. Identification of a Kupffer cell subset capable of reverting the T cell dysfunction induced by hepatocellular priming. Immunity 54(9):2089-2100.e8 (2021).

Debeljak, Natasa. et al. Erythropoietin and Cancer: the Unintended Consequences of Anemia Correction. Frontiers in Immunology 5:563, 1-15 (2014).

Devey, Luke. et al. Tissue-resident macrophages protect the liver from ischemia reperfusion injury via a heme oxygenase-1-dependent mechanism. Molecular Therapy 17(1):65-72 (2009).

Dikiy, Stanislav, and Alexander Y Rudensky. Principles of regulatory T cell function. Immunity 56(2):240-255 (2023).

Dinkova-Kostova, Albena T., and Ian M. Copple. Advances and challenges in therapeutic targeting of NRF2. Trends in pharmacological sciences 44(3):137-149 (2023).

Dixon, Karen O. et al. TIM-3 Restrains Anti-tumour Immunity by Regulating Inflammasome Activation. Nature 595(7865):101-106 (2021).

Dobin, Alexander. et al. STAR: Ultrafast Universal RNA-seq Aligner. Bioinformatics 29(1):15-21 (2013).

Doran, Amanda C. et al. Efferocytosis in health and disease. Nature reviews. Immunology 20(4):254-267 (2020). Published online Dec. 10, 2019.

Dudziak, Diana. et al. Differential Antigen Processing by Dendritic Cell Subsets in Vivo. Science 315(5808):107-111 (2007).

Enders, Marika. et al. Splenic red pulp macrophages cross-prime early effector CTL that provide rapid defense against viral infections. The Journal of Immunology 204(1):87-100 (2020). Published Online Nov. 27, 2019.

Eswarappa, Meghana. et al. Erythropoietin in Lupus: Unanticipated Immune Modulating Effects of a Kidney Hormone. Frontiers in Immunology 12:639370, 1-9 (2021).

Farha, Mark. et al. Characterization of the tumor immune microenvironment identifies M0 macrophage-enriched cluster as a poor prognostic factor in hepatocellular carcinoma. JCO Clinical Cancer Informatics 4:1002-1013 (2020).

Ferris, Stephen T. et al. cDC1 Prime and are Licensed by CD4+ T Cells to Induce Anti-tumour Immunity. Nature 584(7822):624-629 (2020).

Forster, Reinhold. et al. CCR7 and its Ligands: Balancing Immunity and Tolerance. Nature Reviews Immunology 8(5):362-371 (2008).

Fu, Liuhui. et al. RORγt-dependent antigen-presenting cells direct regulatory T cell-mediated tolerance to food antigen. Biorxiv :1-43 (2024).

Gajewski, Thomas F. The next hurdle in cancer immunotherapy: overcoming the non-T-cell-inflamed tumor microenvironment. Seminars in Oncology 42(4):663-671 (2015).

Galon et al. Type, density, and location of immune cells within human colorectal tumors predict clinical outcome. Science 313:1960-1964 (2006).

Galon, Jerome, and Daniela Bruni. Approaches to treat immune hot, altered and cold tumours with combination immunotherapies. Nature reviews Drug discovery 18(3):197-218 (2019).

Gargaro, Marco. et al. Indoleamine 2,3-dioxygenase 1 activation in mature cDC1 promotes tolerogenic education of inflammatory cDC2 via metabolic communication. Immunity 55(6):1032-1050 (2022).

Ge, Yun. et al. Efferocytosis and its role in inflammatory disorders. Frontiers in cell and developmental biology 10:839248, 1-15 (2022).

Genc, Kursad. et al. Erythropoietin induces nuclear translocation of Nrf2 and heme oxygenase-1 expression in SH-SY5Y cells. Cell Biochemistry and Function: Cellular biochemistry and its modulation by active agents or disease 28(3):197-201 (2010).

Gonzales, Gerone A. et al. The pore-forming Apolipoprotein APOL7C Drives Phagosomal Rupture and Antigen Cross-presentation by Dendritic Cells. Science Immunology 9(101):eadn2168, 1-20 (2024).

(56)        References Cited

OTHER PUBLICATIONS

Gozzelino, Raffaella. et al. Mechanisms of cell protection by heme oxygenase-1. Annual review of pharmacology and toxicology 50(1):323-354 (2010).

Grewal et al.: The role of CD40 ligand in costimulation and T-cell activation. Immunol Rev. 153:85-106 (1996).

Gu, Zuguang. et al. Complex Heatmap Visualization. iMeta 1(3):e43, 1-15 (2022).

Han, Yanmei. et al. Tumor-induced generation of splenic erythroblast-like Ter-cells promotes tumor progression. Cell 173(3):634-648.e12 (2018).

Hanayama, Rikinari. et al. Autoimmune disease and impaired uptake of apoptotic cells in MFG-E8-deficient mice. Science 304(5674):1147-1150 (2004).

Hao, Yuhan. et al. Dictionary learning for integrative, multimodal and scalable single-cell analysis. Nature biotechnology 42(2):293-304 (2024).

Hashimoto, Kahoko. et al. A conditional null allele of the major histocompatibility IA-beta chain gene. Genesis 32(2):152-153 (2002).

Hastir, Jean-Francois. et al. Hepatocarcinoma induces a tumor necrosis factor-dependent Kupffer cell death pathway that favors its proliferation upon partial hepatectomy. Frontiers in Oncology 10:547013, 1-13 (2020).

Heinrich, Achim C. et al. A mouse model for visualization and conditional mutations in the erythroid lineage. Blood 104(3):659-666 (2004).

Heymann, Felix. et al. Liver inflammation abrogates immunological tolerance induced by Kupffer cells. Hepatology 62(1):279-291 (2015).

Hildner et al., Batf3 deficiency reveals a critical role for CD8alpha+ dendritic cells in cytotoxic T cell immunity. Science 322:1097-1100 (2008).

Hirano, Ryuichiro. et al. Tissue-resident macrophages are major tumor-associated macrophage resources, contributing to early TNBC development, recurrence, and metastases. Communications Biology 6(1):144, 1-11 (2023).

Hongo, David. et al. Tolerogenic interactions between CD8+ dendritic cells and NKT cells prevent rejection of bone marrow and organ grafts. Blood 129(12):1718-1728 (2017).

Huang, Qizhao. et al. The Primordial Differentiation of Tumor-specific Memory CD8+ T Cells as Bona Fide Responders to PD-1/PD-L1 Blockade in Draining Lymph Nodes. Cell 185(22):4049-4066 (2022).

Huang, Xiangang. et al. Synthesis of siRNA nanoparticles to silence plaque-destabilizing gene in atherosclerotic lesional macrophages. Nature Protocols 17(3):748-780 (2022).

Iberg, Courtney A. et al. Dendritic Cells as Inducers of Peripheral Tolerance. Trends in Immunology 38(11):793-804 (2017).

Iberg, Courtney A. et al. TNF-α sculpts a maturation process in vivo by pruning tolerogenic dendritic cells. Cell Reports 39(2):110657, 1-39 (2022).

Idoyaga, Juliana. et al. Specialized role of migratory dendritic cells in peripheral tolerance induction. The Journal of clinical investigation 123(2):844-854 (2013).

Iyoda, Tomonori. et al. The CD8+ dendritic cell subset selectively endocytoses dying cells in culture and in vivo. The Journal of experimental medicine 195(10):1289-1302 (2002).

Jansen, Caroline S. et al. An Intra-tumoral Niche Maintains and Differentiates Stem-like CD8 T Cells. Nature 576(7787):465-470 (2019).

Jung, Keunok. et al. Protective role of V-set and immunoglobulin domain-containing 4 expressed on kupffer cells during immune-mediated liver injury by inducing tolerance of liver T-and natural killer T-cells. Hepatology 56(5):1838-1848 (2012).

Kapitsinou, Pinelopi P. et al. Hepatic HIF-2 Regulates Erythropoietic Responses to Hypoxia in Renal Anemia. Blood, The Journal of the American Society of Hematology 116(16):3039-3048 (2010).

Kedmi, Ranit. et al. A RORγt+ cell instructs gut microbiota-specific Treg cell differentiation. Nature 610(7933):737-743 (2022).

Kidani, Yujiro. et al. CCR8-targeted specific depletion of clonally expanded Treg cells in tumor tissues evokes potent tumor immunity with long-lasting memory. Proceedings of the National Academy of Sciences 119(7):e2114282119, 1-12 (2022).

Kim, Daehwan. et al. Graph-based Genome Alignment and Genotyping with HISAT2 and HISAT-genotype. Nature Biotechnology 37(8):907-915 (2019).

Kim, Jeong M. et al. Regulatory T Cells Prevent Catastrophic Autoimmunity Throughout the Lifespan of Mice. Nature Immunology 8(2):191-197 (2007).

Kinder, Jeremy. M. et al. Cross-generational reproductive fitness enforced by microchimeric maternal cells. Cell 162(3):505-515 (2015).

Kobayashi, Eri H. et al. Nrf2 suppresses macrophage inflammatory response by blocking proinflammatory cytokine transcription. Nature Communications 7(1):11624, 1-14 (2016).

Kuhrt, David, and Don M Wojchowski. Emerging EPO and EPO receptor regulators and signal transducers. Blood 125(23):3536-3541 (2015).

Kurtulus, Sema. et al. Checkpoint blockade immunotherapy induces dynamic changes in PD-1-CD8+ tumor-infiltrating T cells. Immunity 50(1):181-194 (2019).

Langmead, Ben et al. Fast gapped-read alignment with Bowtie 2. Nature methods 9(4):357-359 (2012).

Lax, Brianna M. et al. Both intratumoral regulatory T cell depletion and CTLA-4 antagonism are required for maximum efficacy of anti-CTLA-4 antibodies. Proceedings of the National Academy of Sciences 120(31):e2300895120, 1-11 (2023).

Lehmann, Christian HK. et al. DC Subset-specific Induction of T Cell Responses Upon Antigen Uptake via Fc gamma Receptors in Vivo. Journal of Experimental Medicine 214(5):1509-1528 (2017).

Lei, Xin. et al. CD4+ Helper T Cells Endow cDC1 With Cancer-impeding Functions in the Human Tumor Micro-environment. Nature Communications 14(1):217, 1-14 (2023).

Li, Jiawei. et al. CHBP Induces Stronger Immunosuppressive CD127+ M-MDSC Via Erythropoietin Receptor. Cell Death and Disease 12(2):177, 1-12 (2021).

Li, Weiyang et al. Heterogeneity and function of kupffer cells in liver injury. Frontiers in Immunology 13:940867, 1-13 (2022).

Liberzon, Arthur et al. The molecular signatures database hallmark gene set collection. Cell systems 1(6):417-425 (2015).

Lisowska, Katarzyna A. et al. Erythropoietin receptor is expressed on human peripheral blood T and B lymphocytes and monocytes and is modulated by recombinant human erythropoietin treatment. Artificial Organs 34(8):654-662 (2010).

Liu, Fu-Tong, and Sean R. Stowell. The Role of Galectins in Immunity and Infection. Nature Reviews Immunology 23(8):479-494 (2023).

Liu, Kang. et al. Immune tolerance after delivery of dying cells to dendritic cells in situ. The Journal of experimental medicine 196(8):1091-1097 (2002).

Liu, Zhaoyuan. et al. Fate mapping via Ms4a3-expression history traces monocyte-derived cells. Cell 178(6):1509-1525 (2019).

Long, Haixia. et al. Tumor-induced erythroid precursor-differentiated myeloid cells mediate immunosuppression and curtail anti-PD-1/PD-L1 treatment efficacy. Cancer cell 40(6):674-693.e7 (2022).

Love, Michael I. et al. Moderated estimation of fold change and dispersion for RNA-seq data with DESeq2. Genome Biology 15(12):550, 1-21 (2014).

Lyu, Mengze. et al. ILC3s select microbiota-specific regulatory T cells to establish tolerance in the gut. Nature 610(7933):744-751 (2022).

Macparland, Sonya A. et al. Single cell RNA sequencing of human liver reveals distinct intrahepatic macrophage populations. Nature Communications 9(1):4383, 1-21 (2018).

Magen, Assaf. et al. Intratumoral Dendritic Cell-CD4+ T Helper Cell Niches Enable CD8+ T Cell Differentiation Following PD-1 Blockade in Hepatocellular Carcinoma. Nature Medicine 29(6):1389-1399 (2023).

Maier, Barbara. et al. A Conserved Dendritic-cell Regulatory Program Limits Antitumour Immunity. Nature 580(7802):257-262 (2020).

(56)        References Cited

OTHER PUBLICATIONS

Mair, Florian. et al. Extricating Human Tumour Immune Alterations From Tissue Inflammation. Nature 605(7911):728-735 (2022).

McEachern, Elisa. et al. Erythropoietin Administration Expands Regulatory T Cells in Patients With Autoimmune Hepatitis. Journal of Autoimmunity 119:102629, 1-7 (2021).

Mcginnis et al. MULTI-seq: sample multiplexing for single-cell RNA sequencing using lipid-tagged indices. Nat Methods. Jul. 2019; 16(7):619-626. doi: 10.1038/s41592-019-0433-8. Epub Jun. 17, 2019.

Mcgrail, D. J. et al. High tumor mutation burden fails to predict immune checkpoint blockade response across all cancer types. Annals of Oncology 32(5):661-672 (2021).

Mehrotra, Parul, and Kodi S. Ravichandran. Drugging the Efferocytosis Process: Concepts and Opportunities. Nature Reviews Drug Discovery 21(8):601-620 (2022).

Meiser, Philippa. et al. A distinct stimulatory cDC1 subpopulation amplifies CD8+ T cell responses in tumors for protective anti-cancer immunity. Cancer Cell 41(8):1498-1515.e10 (2023).

Mellman, Ira. et al. The cancer-immunity cycle: Indication, genotype, and immunotype. Immunity 56(10):2188-2205 (2023).

Meredith et al. Expression of the zinc finger transcription factor zDC (Zbtb46, Btbd4) defines the classical dendritic cell lineage. J Exp Med 209:1153-1165 (2012).

Miller et al., Subsets of exhausted CD8+ T cells differentially mediate tumor control and respond to checkpoint blockade. Nat Immunol. 20(3):326-336 (2019).

Minutti, Carlos M. et al. Distinct ontogenetic lineages dictate cDC2 heterogeneity. Nature Immunology 25(3):448-461 (2024).

Moon, James J. et al. Naive CD4(+) T cell frequency varies for different epitopes and predicts repertoire Diversity and response magnitude. Immunity 27(2):203-213 (2007).

Mootha, V. K. et al. PGC-1alpha-responsive genes involved in oxidative phosphorylation are coordinately downregulated in human diabetes. Nature Genetics 34(3):267-273 (2003).

Murphy, Kenneth M. Transcriptional control of dendritic cell development. Advances in immunology 120:239-267 (2013).

Murphy, Theresa L., and Kenneth M. Murphy. Dendritic cells in cancer immunology. Cellular and molecular immunology 19(1):3-13 (2022). Published Online Sep. 3, 2021.

Narasimhan, Hamsa. et al. Cross-species analyses reveal RORγt-expressing dendritic cells are a lineage of antigen presenting cells conserved across tissues. Biorxiv :1-65 (2024).

Newman, Aaron M et al. Robust Enumeration of Cell Subsets From Tissue Expression Profiles. Nature Methods vol. 12,5: pp. 453-457 (2015).

Noelia, A-Gonzalez. et al. Apoptotic cells promote their own clearance and immune tolerance through activation of the nuclear receptor LXR. Immunity 31(2):245-258 (2009).

Ohara, Ray A. et al. The evolving biology of cross-presentation. Seminars in immunology 66:101711, 1-49 (2023).

Ohl, Lars. et al. CCR7 Governs Skin Dendritic Cell Migration Under Inflammatory and Steady-state Conditions. Immunity 21(2):279-288 (2004).

Parisotto, Yollanda F. et al. Thetis cells induce food-specific Treg cell differentiation and oral tolerance. Biorxiv :1-29 (2024).

Phipson, Belinda. et al. Propeller: testing for differences in cell type proportions in single cell data. Bioinformatics 38(20):4720-4726 (2022).

Pittet, Mikael J. et al. Dendritic Cells as Shepherds of T Cell Immunity in Cancer. Immunity 56(10):2218-2230 (2023).

Prokhnevska, Nataliya. et al. CD8+ T Cell Activation in Cancer Comprises an Initial Activation Phase in Lymph Nodes Followed by Effector Differentiation Within the Tumor. Immunity 56(1):107-124 (2023).

Puttock, E. H. et al. Extracellular matrix educates an immunoregulatory tumor macrophage phenotype found in ovarian cancer metastasis. Nature Communications 14(1):2514, 1-16 (2023).

Rahim, Maha K. et al. Dynamic CD8+ T Cell Responses to Cancer Immunotherapy in Human Regional Lymph Nodes Are Disrupted in Metastatic Lymph Nodes. Cell 186(6):1127-1143 (2023).

Ramirez, Delaney E., and Mary Jo Turk. Th1-like Treg Cells Are Dressed to Suppress Anti-tumor Immunity. Immunity 56(7):1437-1439 (2023).

Rapp, Moritz. et al. CCL22 controls immunity by promoting regulatory T cell communication with dendritic cells in lymph nodes. The Journal of experimental medicine 216(5):1170-1181 (2019).

Ratcliffe, Peter J. HIF-1 and HIF-2: Working Alone or Together in Hypoxia ?. The Journal of Clinical Investigation 117(4):862-865 (2007).

Roberts et al.: Critical Role for CD103(+)/CD141(+) Dendritic Cells Bearing CCR7 for Tumor Antigen Trafficking and Priming of T Cell Immunity in Melanoma. Cancer Cell 30:324-336 (2016).

Robinson, Mark D. et al. edgeR: a Bioconductor package for differential expression analysis of digital gene expression data. bioinformatics 26(1):139-140 (2010).

Roquilly, Antoine. et al. Spatiotemporal adaptations of macrophage and dendritic cell development and function. Annual Review of Immunology 40:525-557 (2022).

Rowe, Jared H. et al. Pregnancy imprints regulatory memory that sustains anergy to fetal antigen. Nature 490(7418):102-106 (2012).

Ruhland, Megan K. et al. Visualizing Synaptic Transfer of Tumor Antigens Among Dendritic Cells. Cancer Cell 37(6):786-799 (2020).

Satpathy et al. Zbtb46 expression distinguishes classical dendritic cells and their committed progenitors from other immune lineages. J Exp Med 209:1135-1152 (2012).

Scandling, John D. et al. Induced Immune Tolerance for Kidney Transplantation. New England Journal of Medicine 365(14):1359-1360 (2011).

Scandling, John D. et al. Macrochimerism and clinical transplant tolerance. Human immunology 79(5):266-271 (2018).

Scandling, John D. et al. Tolerance and Chimerism After Renal and Hematopoietic-cell Transplantation. The New England Journal of Medicine 358(4):362-368 (2008).

Schenkel, Jason M. et al. Conventional type I dendritic cells maintain a reservoir of proliferative tumor-antigen specific TCF-1+ CD8+ T cells in tumor-draining lymph nodes. Immunity 54(10):2338-2353.e6 (2021).

Schulz, Oliver, and Caetano Reis e Sousa. Cross-presentation of Cell-associated Antigens by CD8alpha+ dendritic cells is attributable to their ability to internalize dead cells. Immunology 107(2):183-189 (2002).

Schurch, Christian M. et al. Coordinated cellular neighborhoods orchestrate antitumoral immunity at the colorectal cancer invasive front. Cell 182(5):1341-1359 (2020).

Sendoel, Ataman, and Michael O. Hengartner. Apoptotic Cell Death Under Hypoxia. Physiology 29(3):168-176 (2014).

Shao, Tzu-Yu. et al. Reproductive outcomes after pregnancy-induced displacement of preexisting microchimeric cells. Science 381(6664):1324-1330 (2023).

Siddiqui, Imran et al. Intratumoral Tcf1+ PD-1+ CD8+ T Cells With Stem-like Properties Promote Tumor Control in Response to Vaccination and Checkpoint Blockade Immunotherapy. Immunity 50(1):195-211 (2019).

Silva-Sanchez, Aaron. et al. Activation of regulatory dendritic cells by Mertk coincides with a temporal wave of apoptosis in neonatal lungs. Science immunology 8(84):eadc9081, 1-35 (2023).

Sisirak, Vanja. et al. Digestion of Chromatin in Apoptotic Cell Microparticles Prevents Autoimmunity. Cell 166(1):88-101 (2016).

Slavin, S. et al. Long-term survival of skin allografts in mice treated with fractionated total lymphoid irradiation. Science 193(4259):1252-1254 (1976).

Soares, Miguel P., and Iqbal Hamza. Macrophages and iron metabolism. Immunity 44(3):492-504 (2016).

Spitzer et al. Systemic Immunity Is Required for Effective Cancer Immunotherapy. Cell 168:487-502 (2017).

Spranger, Stefani. et al. Tumor-residing Batf3 dendritic cells are required for effector T cell trafficking and adoptive T cell therapy. Cancer Cell 31(5):711-723.e4 (2017).

(56) References Cited

OTHER PUBLICATIONS

Steinman, Ralph M. et al. The Induction of Tolerance by Dendritic Cells That Have Captured Apoptotic Cells. The Journal of Experimental Medicine 191(3):411-416 (2000).

Subramanian, Aravind. et al. Gene Set Enrichment Analysis: a Knowledge-based Approach for Interpreting Genome-wide Expression Profiles. Proceedings of the National Academy of Sciences of the United States of America 102(43):15545-15550 (2005).

Theisen, Derek, and Kenneth Murphy. The Role of cDC1s in Vivo: CD8 T Cell Priming through Cross-presentation. F1000Res 6:98, 1-10 (2017).

Thomson, Angus W., and Percy A. Knolle. Antigen-presenting cell function in the tolerogenic liver environment. Nature Reviews Immunology 10(11):753-766 (2010).

Thumkeo, Dean. et al. PGE(2)-EP2/EP4 signaling elicits immunosuppression by driving the mregDC-Treg axis in inflammatory tumor microenvironment. Cell reports 39(10):110914, 1-15 (2022).

Tonelli, Marcello. et al. Benefits and Harms of Erythropoiesis-stimulating Agents for Anemia Related to Cancer: A Meta-analysis. CMAJ 180(11):E62-E71 (2009).

Travis, Mark A. et al. Loss of integrin alpha-v-beta-8 on dendritic cells causes autoimmunity and colitis in mice. Nature 449(7160):361-365 (2007).

Tsai, Peter T. et al. A critical role of erythropoietin receptor in neurogenesis and post-stroke recovery. Journal of Neuroscience 26(4):1269-1274 (2006).

Ugur, Milas. et al. Lymph node medulla regulates the spatiotemporal unfolding of resident dendritic cell networks. Immunity 56(8):1778-1793. e1-e10 (2023).

Vallelian, Florence. et al. Heme-stress activated NRF2 skews fate trajectories of bone marrow cells from dendritic cells towards red pulp-like macrophages in hemolytic anemia. Cell Death Differ 29(8):1450-1465 (2022).

Wagener , F. A. et al. Heme is a potent inducer of inflammation in mice and is counteracted by heme oxygenase. Blood 98(6):1802-1811 (2001).

Wang, Guang L., and Gregg L. Semenza. Purification and characterization of hypoxia-inducible factor 1. Journal of biological chemistry 270(3):1230-1237 (1995).

Wang, Qingfei. et al. Understanding and targeting erythroid progenitor cells for effective cancer therapy. Current Opinion in Hematology 30(4):137-143 (2023).

Wei, Xu. et al. Erythropoietin protects against murine cerebral malaria through actions on host cellular immunity. Infection and Immunity 82(1):165-173 (2014).

Welsch, Thilo. et al. Prognostic significance of erythropoietin in pancreatic adenocarcinoma. PLoS One 6(8):e23151, 1-12 (2011).

Wild, Andreas B. et al. CD83 Orchestrates Immunity Toward Self and Non-self in Dendritic Cells. JCI Insight 4(20):e126246, 1-15 (2019).

Wohn, Christian. et al. Absence of MHC class II on cDC1 Dendritic Cells Triggers Fatal Autoimmunity to a Cross-presented Self-antigen. Science Immunology 5(45):eaba1896, 1-12 (2020).

Wu, Renee. et al. Mechanisms of CD40-dependent cDC1 Licensing Beyond Costimulation. Nature Immunology 23(11):1536-1550 (2022).

Wu, Tianzhi. et al. Clusterprofiler 4.0: A Universal Enrichment Tool for Interpreting Omics Data. Innovation 2(3):100141, 1-10 (2021).

Wu, Xiaodi. et al. Mafb lineage tracing to distinguish macrophages from other immune lineages reveals dual identity of Langerhans cells. The Journal of experimental medicine 213(12):2553-2565 (2016).

Yamazaki, Sayuri et al. CD8+ CD205+ splenic dendritic cells are specialized to induce Foxp3+ regulatory T cells. The Journal of Immunology 181(10):6923-6933 (2008).

Yarchoan, Mark. et al. Tumor Mutational Burden and Response Rate to PD-1 Inhibition. N Engl J Med 377(25):2500-2501 (2017).

Yenyuwadee, Sasitorn. et al. The evolving role of tissue-resident memory T cells in infections and cancer. Science Advances 8(33):eabo5871, 1-16 (2022).

Yi, Rulan. et al. Impact of Protein Identity on Tumor-associated Antigen Uptake Into Infiltrating Immune Cells: A Comparison of Different Fluorescent Proteins as Model Antigens. Plos One 17(8):e0272857, 1-12 (2022).

Yin, Weiqin. et al. Erythropoietin regulates energy metabolism through EPO-EpoR-RUNX1 axis. Nature communications 15(1):8114, 1-17 (2024).

Yuen, Vincent Wai-Hin. et al. Using mouse liver cancer models based on somatic genome editing to predict immune checkpoint inhibitor responses. Journal of Hepatology 78(2):376-389 (2023).

Zagorulya, Maria, and Stefani Spranger. Once upon a prime: DCs shape cancer immunity. Trends in cancer 9(2):172-184 (2023).

Zagorulya, Maria. et al. Tissue-specific Abundance of Interferon-gamma Drives Regulatory T Cells to Restrain Dc1-mediated Priming of Cytotoxic T Cells Against Lung Cancer. Immunity 56(2):386-405 (2023).

Zhang, Huan. et al. EpoR-tdTomato-Cre mice enable identification of EpoR expression in subsets of tissue macrophages and hematopoietic cells. Blood 138(20):1986-1997 (2021).

Zhang, Qiming. et al. Landscape and Dynamics of Single Immune Cells in Hepatocellular Carcinoma. Cell 179(4):829-845 (2019).

Zheng, Liangtao. et al. Pan-cancer single-cell landscape of tumor-infiltrating T cells. Science 374(6574):eabe6474, (2021).

Zhu, Qin. et al. deMULTIplex2: robust sample demultiplexing for scRNA-seq. Genome biology 25(1):37, 1-24 (2024).

Zundel, Wayne. et al. Loss of PTEN facilitates HIF-1-mediated gene expression. Genes and development 14(4):391-396 (2000).

Harris, Kevin W. Ligand binding properties of the human erythropoietin receptor extracellular domain expressed in *Escherichia coli*. Journal of Biological Chemistry 267(21):15205-15209 (1992).

Johnson, Dana L. et al. Identification of a 13 amino acid peptide mimetic of erythropoietin and description of amino acids critical for the mimetic activity of EMP1. Biochemistry 37(11):3699-3710 (1998).

McKinney, Matthew, and Murat O. Arcasoy. Erythropoietin for oncology supportive care. Experimental cell research 317(9):1246-1254 (2011).

Middleton, Steven A. et al. Identification of a critical ligand binding determinant of the human erythropoietin receptor evidence for common ligand binding motifs in the cytokine receptor family. Journal of biological chemistry 271(24):14045-14054 (1996).

Wrighton, Nicholas C. et al. Small peptides as potent mimetics of the protein hormone erythropoietin. Science 273(5274):458-463 (1996).

Chiu et al.: Tumor-derived erythropoietin acts as an immunosuppressive switch in cancer immunity. Science 388:376 (2025).

U.S. Appl. No. 18/844,732 Notice of Allowance dated Aug. 12, 2025.

* cited by examiner

FIG. 2

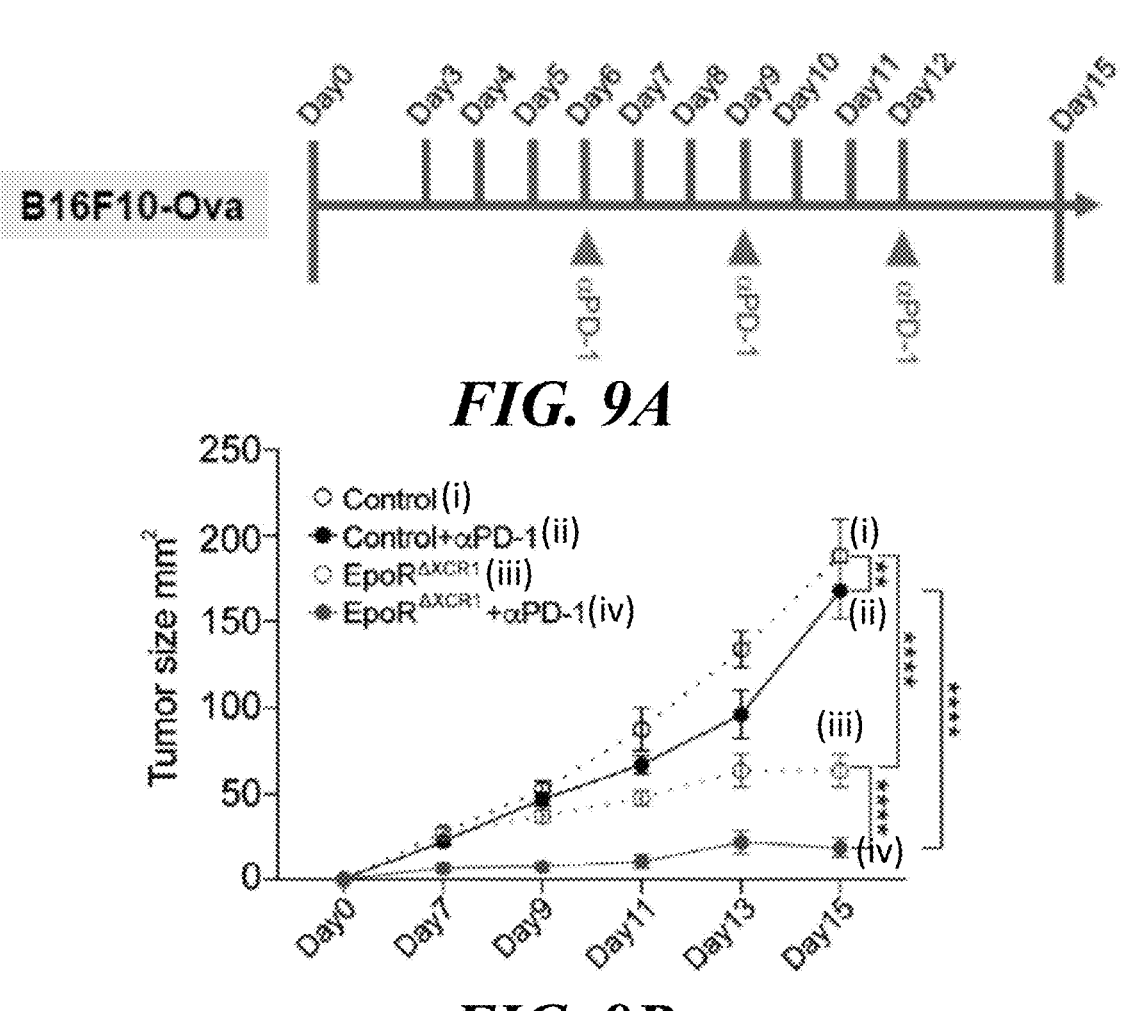
FIG. 9A
FIG. 9B
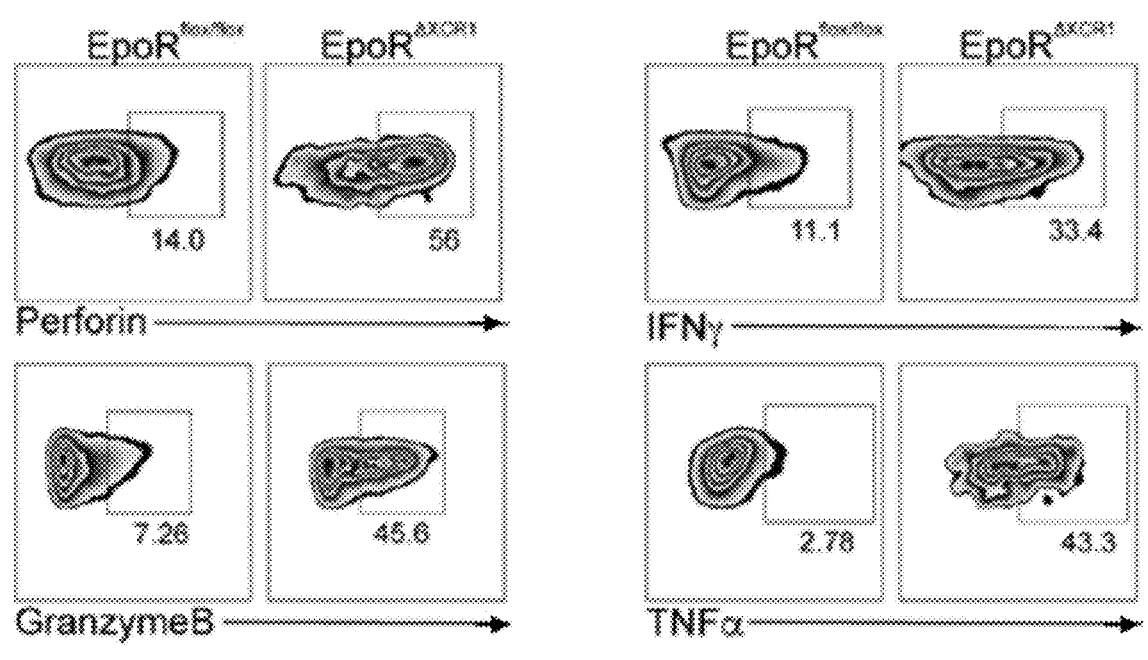
FIG. 9C

| | CR rate (Day 21) | P value (Fisher's exact) |
|---|---|---|
| EV | 6/12 | 0.0137 |
| Epo<sup>OE</sup> | 0/12 | |

CR: Complete Regression

Wild-type mice

EPOR$^{\Delta LysM}$ mice

DSPC:DPPC:Cholesterol:DSPE-PEG-NH2 (1:1:0.5:0.4)
| Z-average (nm) | 245 ± 13 |
| Polydispersity index | 0.18 ± 0.05 |
| Encapsulation efficiency (%) siRNA:NP 1:40 w/w | 81.7 ± 3.54 |
*FIG. 14A*
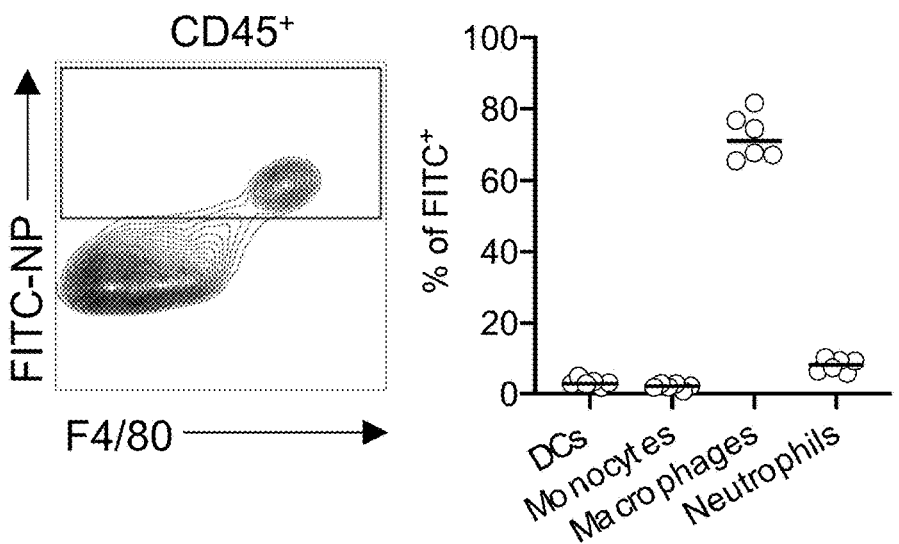
*FIG. 14B*
Macrophages
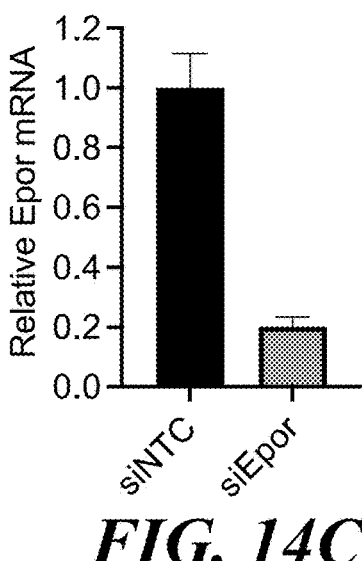
*FIG. 14C*

Liver metastasis patient 1 female, 44yo, mets to liver with a CNS cancer 1°

Liver metastasis patient 2 female, 84yo, mets to liver with a uterine cancer 1°

Liver metastasis patient 3 mets to liver with a colon cancer 1°

Test Group 1

| Antibody ID | Analyte Conc. (nM) |
|---|---|
| EPORab - M1 | 10 |
| EPORab - M2 | 10 |
| EPORab - M3 | 10 |
| EPORab - M4 | 10 |
| EPORab - M5 | 10 |
| EPORab - M6 | 10 |
| EPORab - M7 | 10 |
| Medium (EPO + No Ab) | 10 |

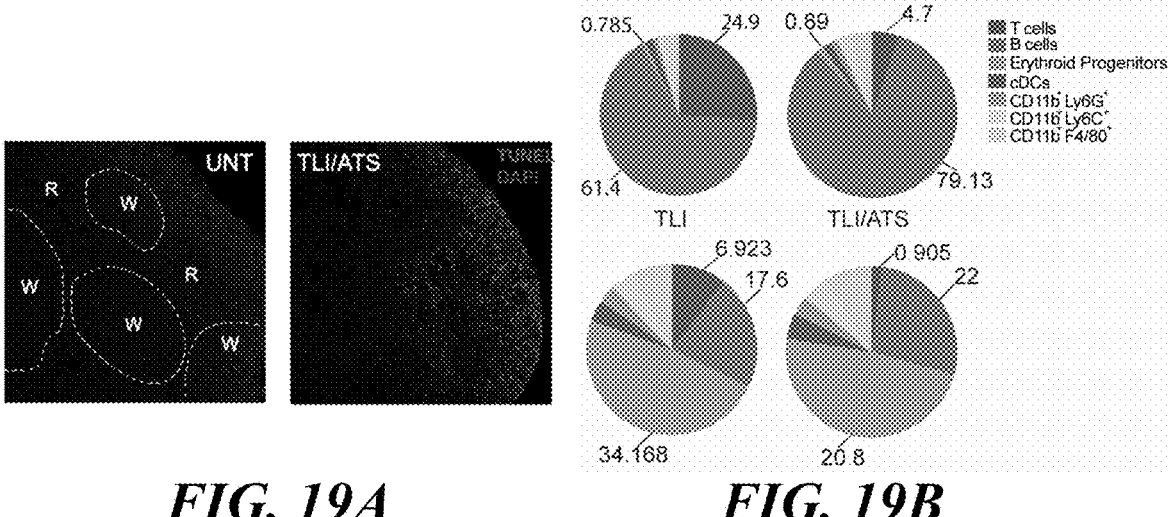
*FIG. 19A*
*FIG. 19B*
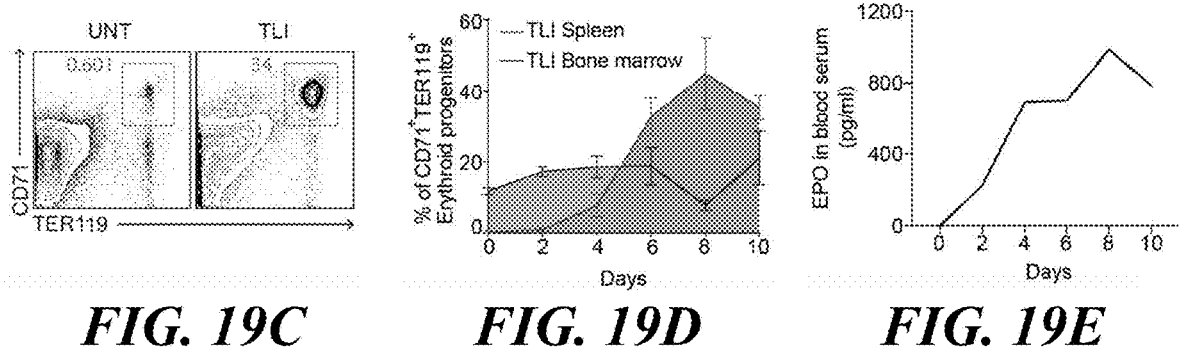
*FIG. 19C*
*FIG. 19D*
*FIG. 19E*

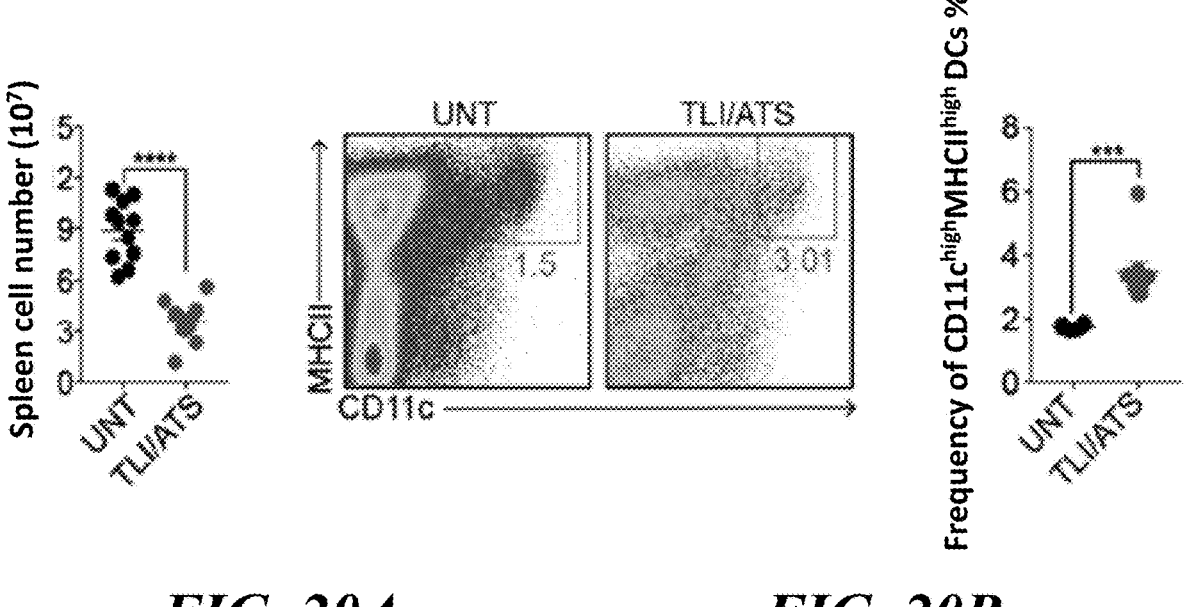
*FIG. 20A*                *FIG. 20B*
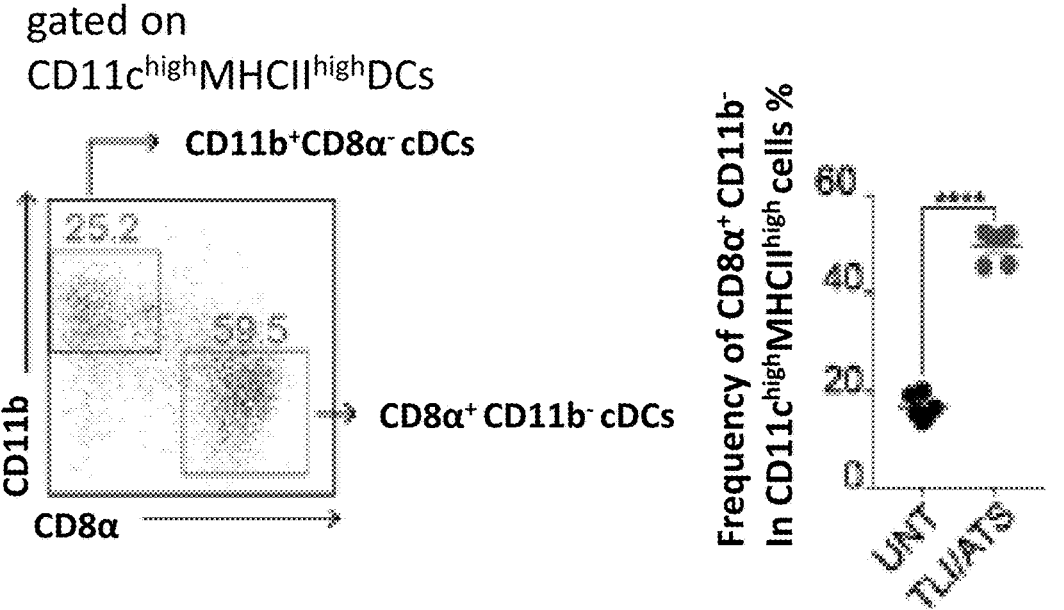
*FIG. 20C*

CD8α⁺ DC1s

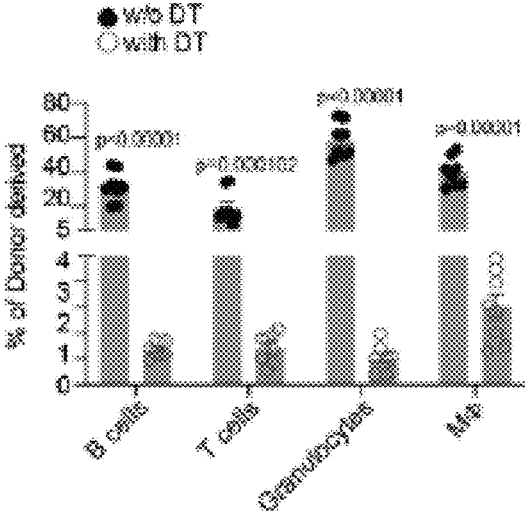
FIG. 24A
FIG. 24D
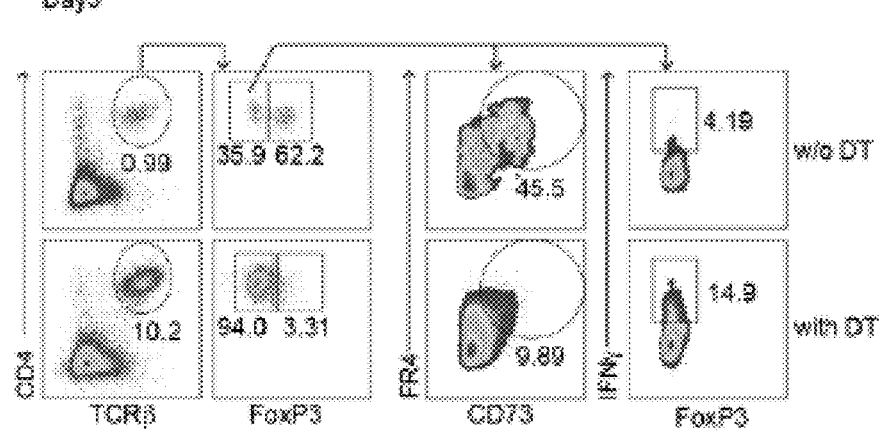
FIG. 24B
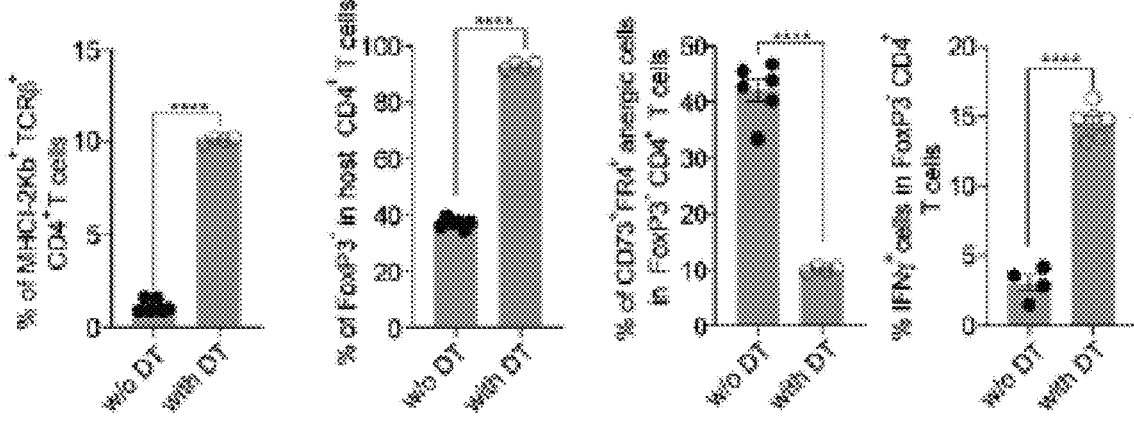
FIG. 24C

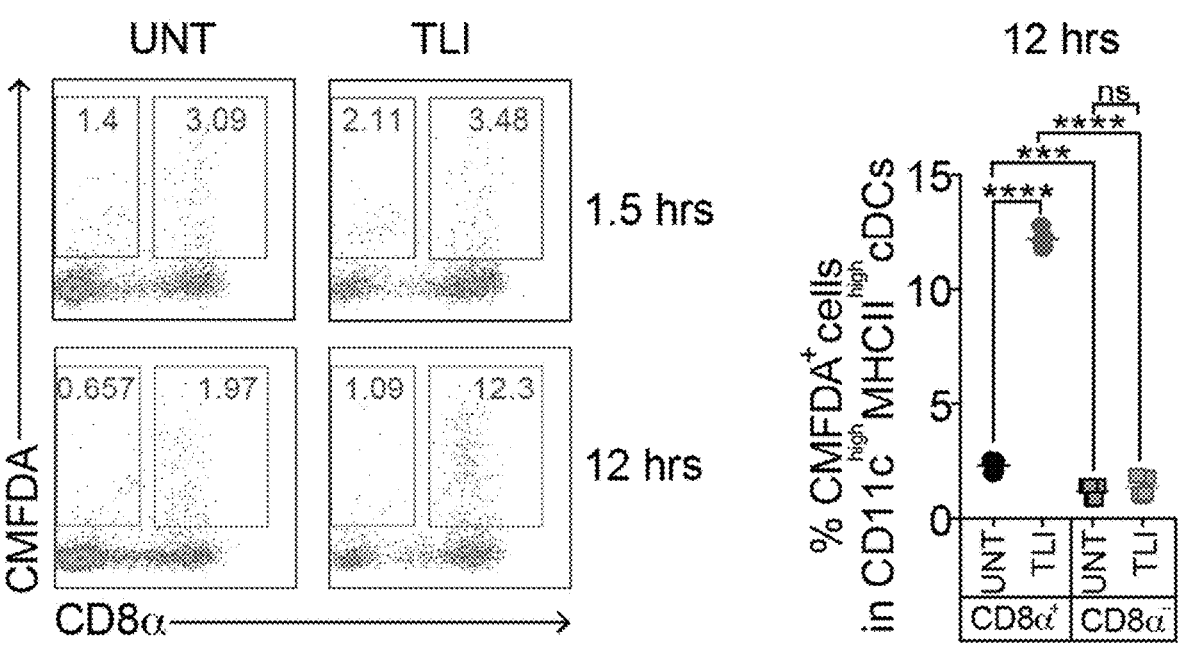
*FIG. 25A*
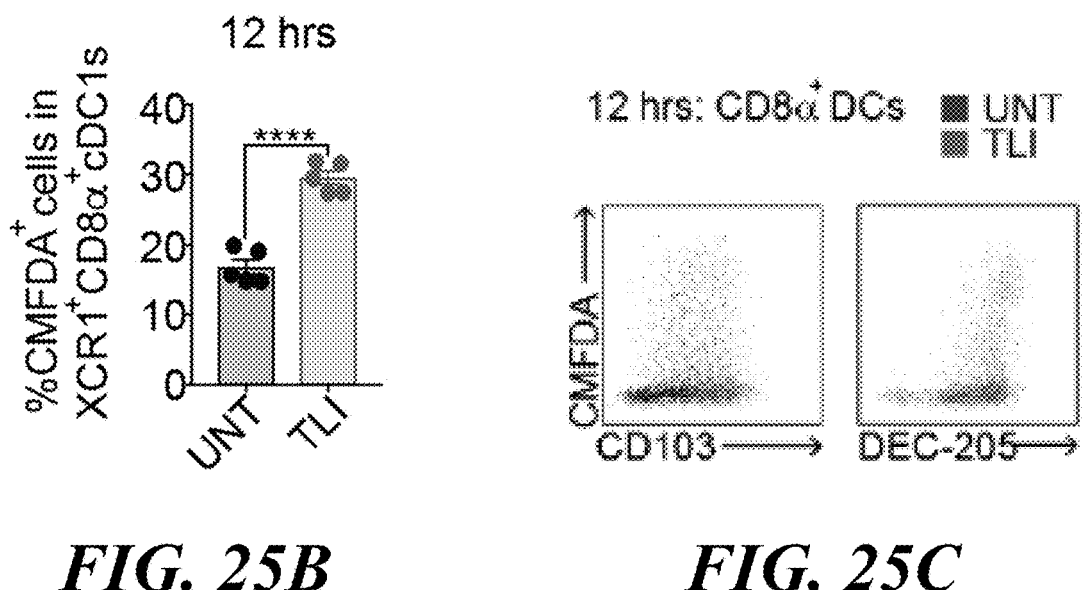
*FIG. 25B*          *FIG. 25C*

CD8α⁺ cDC1s
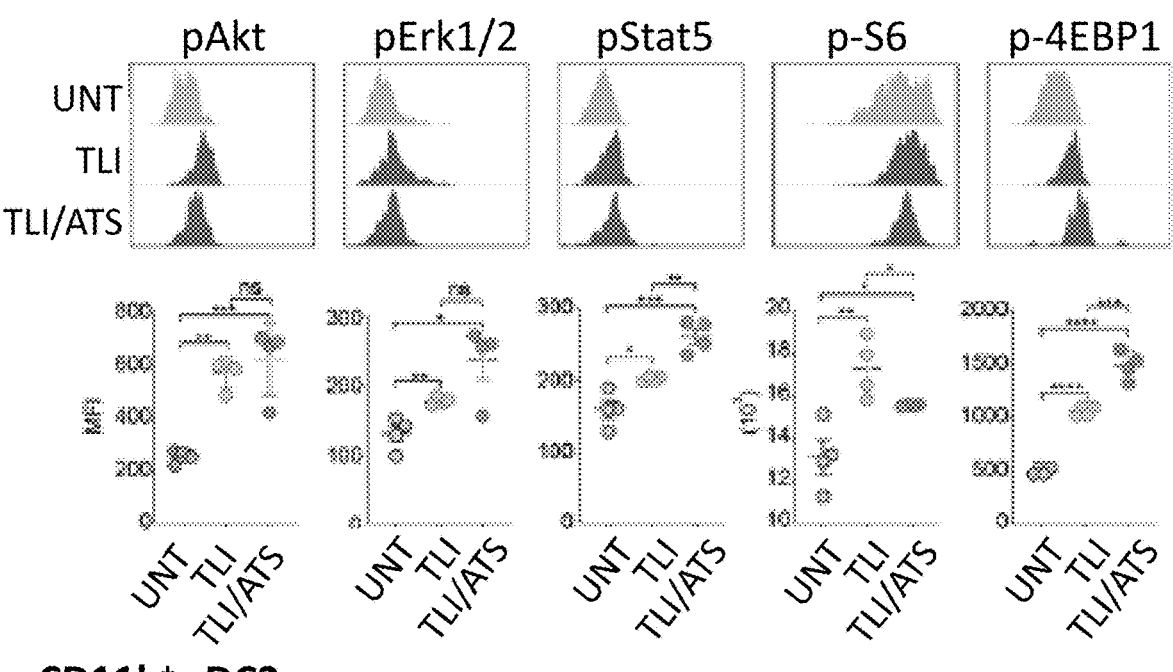
CD11b⁺ cDC2s
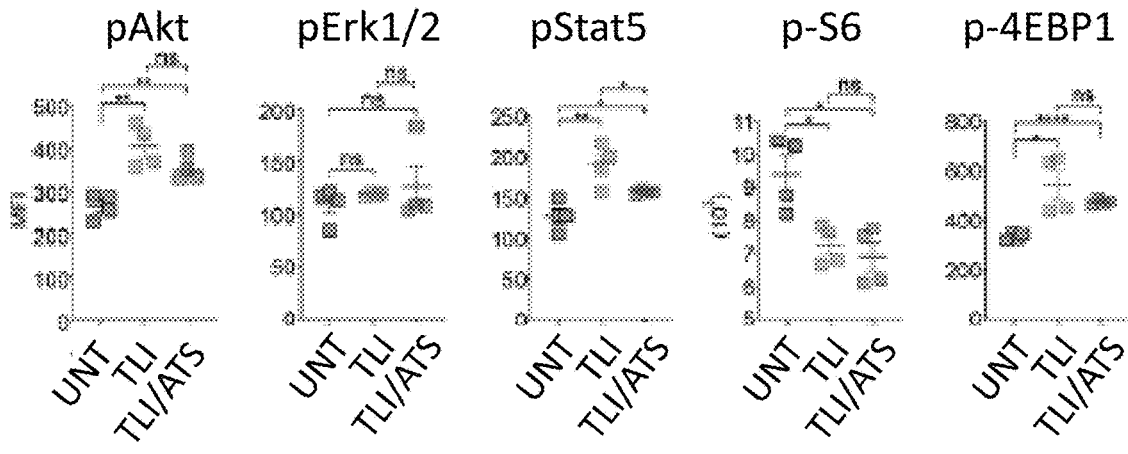
*FIG. 26A*

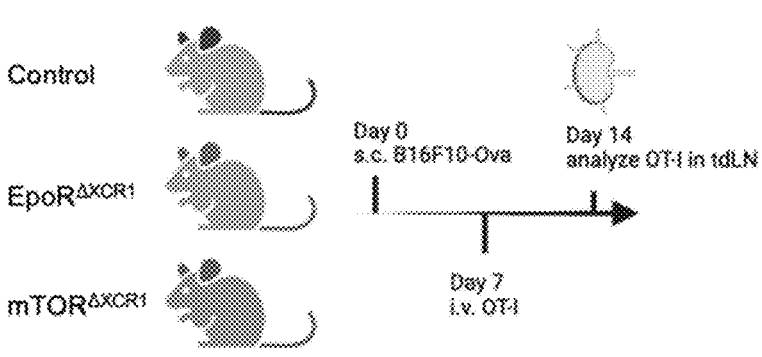
FIG. 27A
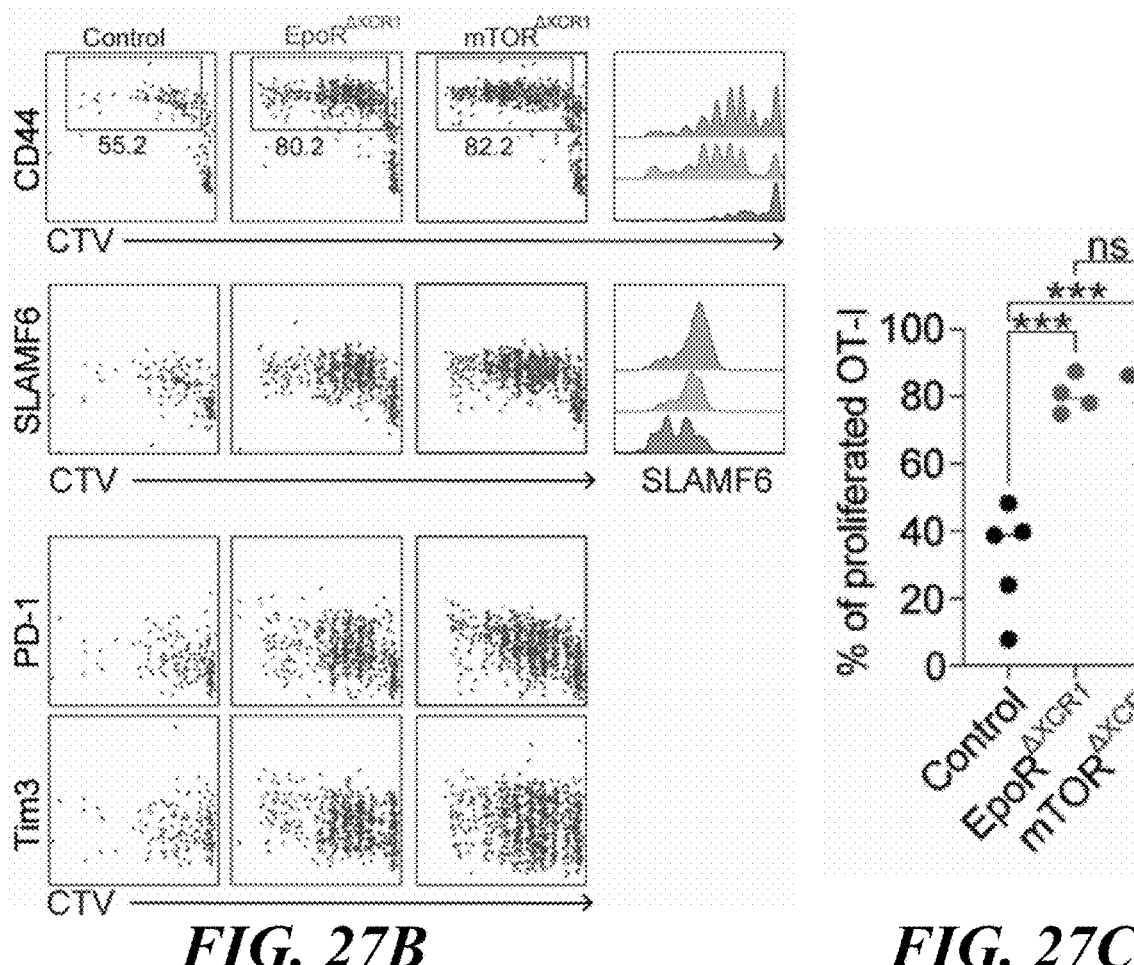
FIG. 27B                          FIG. 27C

| Clones | Cell staining (%) | | | Binding Kinetics of EPOR-CD131-Fc | | | Blocking EPO/EPOR interaction | Binding Kinetics of EPOR-Fc | | | Binding Kinetics of CD131-Fc | | |
|---|---|---|---|---|---|---|---|---|---|---|---|---|---|
| | 293T/EPOR/CD131 | 293T/EPOR | 293T/CD131 | $K_D$ | $k_{on}$ | $k_{dis}$ | | $K_D$ | $k_{on}$ | $k_{dis}$ | $K_D$ | $k_{on}$ | $k_{dis}$ |
| M1 | 53.2 | 55.1 | 20.9 | 8.093E-11 | 331600 | 2.684E-05 | 31.2% | 1.124E-10 | 383100 | 4.31E-05 | - | - | - |
| M2 | 63.9 | 69.6 | 21.8 | 1.735E-10 | 507200 | 8.801E-05 | 93.6% | 1.307E-10 | 578000 | 7.56E-05 | - | - | - |
| M3 | 9.5 | 9.9 | 11.6 | - | - | - | 13.4% | - | - | - | - | - | - |
| M9 | 30.5 | 36.9 | 36.9 | - | - | - | 18.1% | - | - | - | - | - | - |
| M19 | 13.2 | 9.2 | 15.8 | - | - | - | 10.4% | - | - | - | - | - | - |
| M24 | 12.9 | 13.0 | 15.1 | - | - | - | 9.5% | - | - | - | - | - | - |
| M26 | 18.0 | 15.3 | 22.1 | <1.0E-12 | 336800 | <1.0E-07 | 31.3% | <1.0E-12 | 326500 | <1.0E-07 | <1.0E-12 | 365000 | <1.0E-07 |
| M37 | 29.9 | 35.9 | 37.7 | - | - | - | -7.1% | - | - | - | - | - | - |
| M38 | 26.1 | 26.4 | 30.8 | - | - | - | 0.5% | - | - | - | - | - | - |
| M41 | 14.2 | 12.8 | 14.1 | - | - | - | 18.7% | - | - | - | - | - | - |
| M43 | 28.6 | 27.7 | 28.7 | - | - | - | -11.4% | - | - | - | - | - | - |
| M52 | 12.2 | 14.3 | 15.2 | - | - | - | 7.4% | - | - | - | - | - | - |
| M54 | 10.8 | 15.2 | 18.8 | - | - | - | 16.0% | - | - | - | - | - | - |
| M71 | 9.8 | 9.2 | 15.3 | - | - | - | 0.1% | - | - | - | - | - | - |
| M80 | 7.7 | 9.5 | 12.5 | - | - | - | -1.8% | - | - | - | - | - | - |
| M82 | 17.5 | 23.4 | 14.8 | <1.0E-12 | 79640 | <1.0E-07 | 24.8% | - | - | - | <1.0E-12 | 1.77E+05 | <1.0E-07 |
| M87 | 11.3 | 10.2 | 12.1 | - | - | - | 11.5% | - | - | - | - | - | - |

*FIG. 28A*

Lane 1: IME001, non-reducing
Lane 2: IME001, reducing
Lane 3: IME003, reducing
Lane 4: IME004, reducing Lane 1: rhEPO
Lane 2: rhEPO + Lys-C
Lane 3: CEPO
Lane 4: CEPO + Lys-C
Lane 5: BSA control

```
  1   atggggggtgc acgaatgtcc tgcctggctg tggcttctcc tgtccctgct gtcgctccct ctgggcctcc
        M  G  V   H  E  C    P  A  W  L   W  L  L    L  S  L   L  S  L  P    L  G  L 71   cagtcctggg cgccccacca cgcctcatct gtgacagccg agtcctggag aggtacctct tggaggccaa
        P  V  L   G  A  P  P   R  L  I   C  Q  S   R  V  L  E   R  Y  L   L  E  A 141   ggaggccgag aatatcacga cgggctgtgc tgaacactgc agcttgaatg agaatatcac tgtcccagac
        K  E  A  E   N  I  T   T  G  C   A  E  H  C   S  L  N   E  N  I   T  V  P  D 211   accaaagtta atttctatgc ctggaagagg atggaggtcg ggcagcaggc cgtagaagtc tggcagggcc
        T  K  V   N  F  Y   A  W  K  R   M  E  V   G  Q  Q   A  V  E  V   W  Q  G 281   tggccctgct gtcggaagct gtcctgcggg gccaggccct gttggtcaac tcttcccagc cgtgggagcc
        L  A  L   L  S  E  A   V  L  R   G  Q  A   L  L  V  N   S  S  Q   P  W  E 351   cctgcagctg catgtggata aagccgtcag tggccttcgc agcctcacca ctctgcttcg ggctctggga
        P  L  Q  L   H  V  D   K  A  V   S  G  L  R   S  L  T   T  L  L   R  A  L  G 421   gcccagaagg aagccatctc ccctccagat gcggcctcag ctgctccact ccgaacaatc actgctgaca
        A  Q  K   E  A  I   S  P  P  D   A  A  S   A  A  P   L  R  T  I   T  A  D 491   ctttccgcaa actcttccga gtctactcca atttcctccg gggaaagctg aagctgtaca caggggaggc
        T  F  R   K  L  F  R   V  Y  S   N  F  L   R  G  K  L   K  L  Y   T  G  E 561   ctgcaggaca ggggacaga
        A  C  R  T   G  D  R
```

FIG. 34

EpoR-tdT-cre: Rosa26-lox-Stop-lox-EYFP w/o EPO
+ EPO

Injection site

Mammary fat pad injection
Inguinal LN

CD45.1⁺OTII w/o EPO        +EPO

FoxP3

7.23        58.3

CTV ⟶

% of FoxP3⁺cells in adoptively transferred OTII w/o EPO    +EPO w/o EPO
+EPO

FoxP3

MFI of FoxP3 expression on adoptively transferred OTII w/o EPO    +EPO

ANTIBODIES THAT INHIBIT ERYTHROPOIETIN RECEPTOR ACTIVATION AND METHODS OF USE THEREOF TO TREAT CANCER

CROSS-REFERENCE

This application is a national phase entry of International Application No. PCT/US2023/063997, filed on Mar. 8, 2023, which claims the benefit of U.S. Provisional Application No. 63/317,943, filed on Mar. 8, 2022, each of which is incorporated herein by reference in its entirety.

SEQUENCE LISTING

The instant application contains a Sequence Listing which has been submitted electronically in XML format and is hereby incorporated by reference in its entirety. Said XML copy, created on May 1, 2023, is named 62379-703_601_SL.xml and is 3,396,176 bytes in size.

BACKGROUND OF THE DISCLOSURE

Erythropoietin (EPO) induces hematopoiesis by dimerizing EPO receptor (EPOR) molecules, which leads to the activation of the EPO receptor-associated Janus tyrosine kinase 2 (Jak2) and secondary signaling molecules such as Ssignal transducer and activator of transcription 5 (Stat5; Brines and Cerami, Nat Rev Neurosci, 2005; 6:484-94). EPO acts by binding to EPOR which is expressed on erythroid progenitor cells to inhibit apoptosis and promote cell survival, proliferation, and differentiation in production of mature red blood cells (FIG. 1). However, EPOR expression is not restricted to erythroid tissue. EPOR is also expressed in a number of non-hematopoietic tissues and elicits tissue protective effects in ischemic injury and promotes wound healing, cardiovascular protection, angiogenesis, neuroprotection, regulation of metabolic homeostasis, and bone remodeling.

SUMMARY OF THE DISCLOSURE

There are two major tyrosine kinase receptors for EPO: the homodimeric EPOR/EPOR ("homo-EPOR") and the heterodimeric EPOR/CD131 receptor ("hetero-EPOR"). The homo-EPOR signaling is critical for erythropoiesis, whereas the hetero-EPOR signaling is known to have tissue protection activities and can be involved in EPO-mediated immune-modulatory function on immune cells (e.g., myeloid cells, T-cells and B cells). Modulation of the EPO signaling through the hetero-EPOR can provide benefits in various pathological conditions, including but not limited to, inhibiting or stimulating immune response, inducing or breaking antigen-specific tolerance, stimulating erythropoiesis without immune tolerogenic or suppressive effects, providing neuroprotection and tissue protection without stimulating erythropoiesis, and inducing prophylactic or therapeutic immunity.

The present disclosure relates to new erythropoietin (EPO) analogs, and new EPO related antibodies. EPO analogs disclosed herein can include, for example, eight types. EPO analogs can bind the hetero-EPOR and not the homo-EPOR, and can be either agonists or antagonists of the hetero-EPOR. Other EPO analogs can bind the homo-EPOR and not the hetero-EPOR, and can be either agonists or antagonists of the homo-EPOR. EPO analogs can bind both the homo-EPOR and the hetero-EPOR and be agonists for both, antagonists for both, or agonist for one and antagonist for the other. At least four types of anti-EPO receptor (anti-EPOR) antibodies can be obtained. Anti-EPOR antibodies can be agonists or antagonists of the hetero-EPOR, and anti-homo-EPOR antibodies can be agonists or antagonists of the homo-EPOR. At least two types of anti-CD131 antibodies can be obtained. Anti-CD131 antibodies can be agonists or antagonists of the hetero-EPOR. At least three types of anti-EPO antibodies can be obtained. Anti-EPO antibodies can inhibit binding to the homo-EPOR, inhibit binding to the hetero-EPOR, or inhibit EPO binding to both homo-EPOR and hetero-EPOR.

The antibodies disclosed herein, can include fragments thereof that specifically bind to the homo-EPOR, the hetero-EPOR, EPO, CD131, or a combination thereof with high binding affinity (collectively the hetero-EPOR and homo-EPOR are called "EPOR"). The antibodies can be monoclonal, and can be human, chimeric, or humanized antibodies. Chimeric anti-EPOR antibodies and/or anti-EPO antibodies, including fragments thereof, may have non-human (e.g., murine) complementarity-determining regions (CDRs) and/or non-human framework region(s), and optionally one or more human constant domains. Humanized anti-EPOR antibodies and/or humanized anti-EPO antibodies, including fragments thereof, may have non-human (e.g., murine) CDRs and/or human framework region(s), and optionally non-human framework amino acid residues adjacent to CDRs and optionally one or more human constant domains. In some embodiments, antibodies disclosed herein can be grafted antibodies.

The humanized antibodies disclosed herein can represent anti-EPOR and/or anti-EPO antibodies obtained from grafting the CDRs into a human framework for a heavy chain and/or a human framework for a light chain, along with a select number of framework residues from the mouse antibody. Anti-EPOR antibodies and/or anti-EPO antibodies disclosed herein also include those obtained from an affinity maturation library made from an anti-EPOR antibody or anti-EPO antibody. An anti-EPOR antibody and/or an anti-EPO antibody can also include a heavy chain variable region that has 99%, 95%, 90%, 80% or 70% sequence identity with one of the heavy chains, and a light chain variable region that has 99%, 95%, 90%, 80% or 70% sequence identity with one of the light chains. An anti-EPOR antibody can bind to a homo-EPOR or a hetero-EPOR with an affinity of from about 0.1 pM to about 300 nM, from about 1.0 nM to about 10.0 nM, from about 50 nM to about 100 nM, or from about 1.0 to about 100 nM. An anti-EPOR antibody can bind to a homo-EPOR or a hetero-EPOR with an affinity of at least about 100 nM, at least about 50 nM, at least about 10 nM, at least about 5 nm, or at least about 1.0 nM. An anti-EPO antibody can bind to EPO with an affinity of from about 1.0 nM to about 10 nM, from about 50 nM to about 100 nM, or from about 1.0 to about 100 nM. An anti-EPO antibody can bind to EPO with an affinity of at least about 100 nM, at least about 50 nM, at least about 10 nM, at least about 5.0 nm, or at least about 1.0 nM.

The anti-EPOR antibodies and/or anti-EPO antibodies described herein may include modifications that provide a desired property to the antibody. For example, modifications can increase the serum half-life of the antibody or the modification can decrease serum half-life. The modification can also increase or decrease the effector function of the antibody. The modification can decrease immunogenicity, or reduce other unwanted side effects or adverse events caused by the antibodies.

EPO analogs that are antagonists for the hetero-EPOR, anti-hetero-EPOR antibodies that are antagonists for the hetero-EPOR, anti-CD131 antibodies that are antagonists for the hetero-EPOR, and/or anti-EPO antibodies that inhibit binding of EPO to the hetero-EPOR can be used to overcome immunosuppressive or tolerogenic states in a subject. For example, these EPO analogs, anti-hetero-EPOR antibodies, anti-CD131 antibodies and/or anti-EPO antibodies can be used to overcome a tumor immune suppressive microenvironment, boost immune response to vaccines, and/or enhance the immune response during an acute inflammatory response to disease (e.g., an infection from a microorganism or a virus).

EPO analogs that are agonists for the hetero-EPOR, anti-CD131 antibodies that are agonists for the hetero-EPOR, and/or anti-EPOR antibodies that are agonists for the hetero-EPOR can be used to induce a negative immune modulation in a subject (e.g., an immunosuppressive or tolerogenic state). For example, these EPO analogs, anti-CD131 antibodies that are agonists for the hetero-EPOR, and/or anti-hetero-EPOR antibodies can be used to suppress transplant rejection, induce antigen specific immune tolerance, reduce immune reaction in autoimmune diseases, reduce systemic chronic inflammation, and reduce damage to neural tissue and other tissue during injury or other stress. These EPO analogs, anti-CD131 antibodies that are agonists for the hetero-EPOR, and/or anti-hetero-EPOR antibodies can also be administered with an antigen to induce an immunotolerogenic state to the antigen.

EPO analogs that are agonists for the homo-EPOR and do not bind or are antagonists of the hetero-EPOR, and/or anti-EPO antibodies that inhibit binding of EPO to the hetero-EPOR, and/or anti-CD131 antibodies that inhibit binding of EPO to the hetero-EPOR, and/or anti-hetero-EPOR antibodies that are antagonists for the hetero-EPOR can be used with or without erythropoietin-stimulating agents (ESA) for cancer patients in need to an ESA treatment. Any cancer patient needing an ESA can be provided the ESA combined with these EPO analogs, and/or anti-EPOR antibodies, and/or anti-EPO antibodies.

Modulation of signaling from the homo-EPOR or hetero-EPOR can be done with RNA or small molecules. Stimulation of signaling from the homo-EPOR or hetero-EPOR may be achieved by delivery of mRNA of a positive regulator, siRNA of a negative regulator, small molecules that upregulate a positive regulator, or small molecules that downregulate a negative regulator. Inhibition of signaling from the homo-EPOR or hetero-EPOR may be achieved by delivery of mRNA of a negative regulator, siRNA of a positive regulator, small molecules that upregulate a negative regulator, or small molecules that downregulate a positive regulator.

In some aspects, provided herein, is a composition comprising an antibody or a functional fragment thereof, wherein: (i) said antibody or said functional fragment thereof selectively binds to a target comprising an erythropoietin (EPO) protein, an EPO receptor subunit, a CD131 subunit, or a combination thereof, (ii) binding of said antibody or said functional fragment thereof to said target prevents (a) formation of an EPO protein-hetero-EPO receptor complex, wherein said hetero-EPO receptor comprises said EPO receptor subunit and said CD131 subunit, (b) formation of a hetero-EPO receptor between said EPO receptor subunit and said CD131 subunit, or (c) activation of a hetero-EPO receptor, wherein said hetero-EPO receptor comprises said EPO receptor subunit and said CD131 subunit; and (iii) said antibody or said functional fragment thereof comprises an antigen binding domain.

In some aspects, provided herein is a method for treating cancer, wherein said method comprises administering a composition or a derivative thereof to a subject having cancer or at risk of having cancer, wherein said composition or said derivative thereof inhibits a hetero-erythropoietin (EPO) receptor activity in said subject.

In some aspects, provided herein, is a composition comprising an antibody or a functional fragment thereof, wherein: (i) said antibody or said functional fragment thereof selectively binds to a target comprising an erythropoietin (EPO) protein, an EPO receptor subunit, a CD131 subunit, or a combination thereof, (ii) binding of said antibody or said functional fragment thereof to said target promotes (a) formation of an EPO protein-hetero-EPO receptor complex, wherein said hetero-EPO receptor comprises said EPO receptor subunit and said CD131 subunit, (b) formation of a hetero-EPO receptor between said EPO receptor subunit and said CD131 subunit, or (c) activation of a hetero-EPO receptor, wherein said hetero-EPO receptor comprises said EPO receptor subunit and said CD131 subunit; and (iii) said antibody or said functional fragment thereof comprises an antigen binding domain.

In some aspects, provided herein is a composition for administering to a subject having cancer or chronic infection condition, wherein said composition or derivative thereof inhibits erythropoietin (EPO) receptor activity in a myeloid cell in said subject.

In some aspects, provided herein, is a composition for administering to a subject having cancer or chronic infection condition, comprising a compound, a pharmaceutically acceptable salt, solvate, or stereoisomer thereof, wherein said compound inhibits an erythropoietin (EPO) receptor activity in a myeloid cell in said subject.

In some aspects, provided herein is a composition for administering to a subject having cancer or chronic infection condition, comprising a compound, a pharmaceutically acceptable salt, solvate, or stereoisomer thereof, wherein said compound inhibits an erythropoietin (EPO) receptor activity so that an immune-checkpoint blockade resistance is reversed in said subject.

INCORPORATION BY REFERENCE

All publications, patents, and patent applications mentioned in this specification are herein incorporated by reference to the same extent as if each individual publication, patent, or patent application was specifically and individually indicated to be incorporated by reference.

BRIEF DESCRIPTION OF THE DRAWINGS

A better understanding of features and advantages of the present disclosure will be obtained by reference to the following detailed description, which sets forth illustrative embodiments of the disclosure, and the accompanying drawings.

FIG. 2 is an overview of immune tolerance mediated by EPO and the hetero-EPOR in dendritic cells and macrophages.

FIG. 3A shows a volcano plot of genes upregulated and downregulated in EpoR$^+$ XCR1$^+$CD8$\alpha^+$cDC1s vs. EpoR$^-$ XCR1$^+$CD8$\alpha^+$ cDC1s. XCR1: XC-Chemokine Receptor 1. CD8α: Cluster of Differentiation 8α. cDC1: Conventional Type 1 Dendritic Cells. FIG. 3B shows a heat map representing RNA-seq gene expression of the top upregulated and downregulated genes in EpoR$^+$ vs. EpoR$^-$.

FIG. 4A shows hetero-EPOR expression in DCs. FIG. 4B shows the number of donor TCRβ$^+$ T cells in mice (C57BL/6J), Batf3 knockout mice (Batf3$^{-/-}$), mice with CD11c$^{Cre}$ (CD11c$^{Cre}$), mice with EPOR$^{flox/flox}$ (EPOR$^{flox/flox}$) and mice with knockout of hetero-EPOR in dendritic cells (EPOR$^{\Delta CD11c}$). TCRβ: T-Cell Receptor β. Batf3: Basic Leucine Zipper ATF-Like Transcription Factor 3. CD11c: Cluster of Differentiation 11c. P values by the 2-tailed t test of independent means. *P<0.05; P<0.01; *P<0.001; ns, not significant (P>0.05). FIG. 4C shows percent of heart survival of C57BL/6J, Batf3$^{-/-}$, EPOR$^{flox/flox}$ and EPOR$^{\Delta CD11c}$ mice after heart transplant (TX). WT TX (C57BL/6J) vs Batf3$^{-/-}$ TX: P<0.001; WT TX (C57BL/6J) vs EpoR$^{\Delta XCR1}$ TX: P<0.001, log-rank; Mantel-Cox test.

FIG. 5A shows percent of FoxP3$^+$ Tregs in transgenic mice expressing mouse alpha-chain and beta-chain T-cell (OT-II mice) with expression of (i) hetero-EPOR in cDC1s (EpoR$^+$ cDCs) or with (ii) no expression of hetero-EPOR in cDC1s (EpoR$^-$ cDCs) that are untreated (UNT) or treated with EPO (+EPO). FoxP3: Forkhead box P3. P values by the 2-tailed t test of independent means. *P<0.05; P<0.01; *P<0.001; ns, not significant (P >0.05). FIG. 5B shows flow cytometry data measuring Ag-specific Treg of C57BL/6 mice or mice with knockout of EPOR in dendritic cells (EPOR$^{\Delta CD11c}$), treated with total lymphoid irradiation and anti-thymocyte serum (TLI/ATS) or untreated (UNT).

FIG. 6A shows lung tumor size (Lewis lung carcinoma) of (i) wild-type (WT) mice, (ii) wild-type mice with PD-L1 treatment (WT+αPD-L1) and (iii) mice with knockout of hetero-EPOR in macrophages (EpoR$^{\Delta LysM}$). PD-L1: Programmed Death Ligand 1. FIG. 6B shows tumor size (breast adenocarcinoma) of (i) WT mice and (ii) mice with knockout of hetero-EPOR in dendritic cells (EPOR$^{\Delta CD11c}$).

FIG. 7A shows expression of EPOR-tdT in various immune cells of Zbtb46$^{gfp/+}$ EpoR$^{tdTomato/+}$ mice. FIG. 7B shows tumor size (colon cancer) of (i) mice with hetero-EPOR deletion in dendritic cells (EpoR$^{\Delta XCR1}$) versus (ii) mice without hetero-EPOR deletion (EPOR$^{flox/flox}$) FIG. 7B shows tumor size of (i) mice with mTOR deletion in dendritic cells (mTOR$^{\Delta XCR1}$) versus (ii) mice without mTOR deletion (mTOR$^{flox/flox}$) mTOR: Mammalian target of Rapamycin. Data are mean±Standard Error of the Mean (s.e.m.) *P<0.05, P<0.01, *P<0.001 and **P<0.0001, two-way ANOVA. FIG. 7C shows a picture of EPOR$^{\Delta XCR1}$ and EPOR$^{flox/flox}$ mice on day 14 (left) and tumor size of mice with mTOR deletion in EPOR$^{\Delta XCR1}$ versus EPOR$^{flox/flox}$ on day 14 (right). Scale bar as indicated. Mean of the size of tumors. P values by the 2-tailed t test of independent means. *P<0.001.

FIG. 8A illustrates an experimental scheme for administering anti-Programmed Death-1 antibody (αPD-1) to mice bearing cold hepatocellular carcinoma (HCC). A spontaneous model of cold HCC was created by delivering plasmids pCMV-SB13, pT3-EF1a-C-Myc-IRES-Luciferase, and pX330-sgRNA targeting Trp53 to the liver of mice using hydrodynamic tail vein injection (HDTV) in vivo. After two weeks, mice of the C57BL/6 wild-type (WT) and Epor$^{\Delta LysM}$ strains were treated with either 2 mg/kg of αPD-1 or IgG isotype control via intraperitoneal injection every three days for a total of five doses. Trp53: cellular tumor antigen p53. C-myc: c-Myc oncoprotein. Luc: luciferase. FIG. 8B shows the tumor growth kinetics of wild type mice treated with IgG isotype (WT IgG Isotype), wild type mice treated with αPD-1 (WT αPD-1), mice with macrophage specific knockout of hetero-EPOR treated with IgG isotype (Epor$^{\Delta LysM}$ IgG Isotype), and mice with macrophage specific knockout of hetero-EPOR treated with αPD-1 (Epor$^{\Delta LysM}$ αPD-1), analyzed by measuring the luciferin-based bioluminescence. FIG. 8C shows survival curve of WT IgG Isotype, WT αPD-1, Epor$^{\Delta LysM}$ IgG Isotype, and Epor$^{\Delta LysM}$ αPD-1.

FIGS. 9A-9C illustrate change in immune checkpoint blockade resistant cold tumor of mice with EPO knockout in dendritic cells. FIG. 9A illustrates an experimental scheme of treating melanoma mice with αPD-1 (Programmed Death-1). FIG. 9B shows tumor size (melanoma) of (i) control mice, (ii) control mice treated with αPD-1 (Control+ αPD-1), (iii) mice with hetero-EPOR deletion in dendritic cells (EpoR$^{\Delta XCR1}$) and (iv) mice with hetero-EPOR deletion in dendritic cells treated with αPD-1 (EpoR$^{\Delta XCR1}$+αPD-1). *P<0.05, P<0.01, *P<0.001 and ****P<0.0001, two-way ANOVA. FIG. 9C shows flow cytometry data measuring perforin, granzymeB, interferon-gamma (IFNγ), and tumor necrosis factor alpha (TNFα) in mice without deletion of hetero-EPOR (EPOR$^{flox/flox}$) and in mice with hetero-EPOR deletion in dendritic cells (EpoR$^{\Delta XCR1}$).

FIG. 11A illustrates an experimental scheme of establishing regressive HCC model. Allogeneic 3×10$^6$ Hepa1-6 cells were orthotopically implanted in C57BL/6 mice. Two Hepa1-6 stable cell lines were generated using lentivirus either with EPO overexpression (Hepa1-6_Epo$^{OE}$) or empty vehicle (Hepa1-6_EV). FIG. 11B shows tumors from hepatocellular carcinoma mice treated with Hepa1-6_EV or Hepa1-6_Epo$^{OE}$ harvested on Day 14 and Day 21 following injection. FIG. 11C shows quantification of tumor volume and complete regression (CR) rate measurements of HCC mice treated with Hepa1-6_EV or Hepa1-6_Epo$^{OE}$.

FIG. 12A shows change in colon tumor volume of wild type mice with or without liver metastasis. FIG. 12B shows change in colon tumor volume of mice with EPOR deletion in macrophages (EpoR$^{\Delta LysM}$) and with or without liver metastasis.

FIG. 13A illustrates an experimental scheme of liposome treatment in two HCC models. Hepa1-6_Epo$^{OE}$: 3×10$^6$ EPO-overexpressing Hepa1-6 cells were orthotopically implanted in C57BL/6 mice. After one week, mice were treated with liposomes containing 50 µg of either siEpor (siRNA targeting EPOR) or siNTC (non-target control) RNA via intravenous injection every four days for a total of three doses.

HDTV: a spontaneous model of cold HCC was created by delivering plasmids pCMV-SB13, pT3-EF1a-C-Myc, and pX330-sgRNA targeting Trp53 to the liver of mice using hydrodynamic tail vein injection (HDTV) in vivo. After two weeks, mice were treated with liposomes containing 50 µg of either siEpor or siNTC RNA via intravenous injection every four days for a total of six doses. FIG. 13B shows tumor harvested from hepatocellular carcinoma mice treated with liposomes containing either siEpor or siNTC (left) and tumor volume (right). FIG. 13C shows liver harvested from mice with cold HCC treated with liposomes containing either siEpor or siNTC (left) and liver weight (right).

FIGS. 14A-14C illustrate effect of macrophage-targeted liposomes loaded with siRNA targeting hetero-EPOR. FIG. 14A shows physical properties of the macrophage-targeted liposomes. FIG. 14B shows flow cytometry analysis indicating macrophages as the major cell type that take up the liposomes. C57BL/6 mice implanted with Hepa1-6_Epo$^{OE}$ were administrated with liposomes loaded with 50 µg of fluorescein isothiocyanate (FITC)-conjugated siRNA. After 24 hours, tumors were harvested and dissociated into single cell suspension. Flow cytometry analysis was performed to measure the percentage of FITC$^+$ cells in different myeloid cell types. FIG. 14C shows the knockdown efficiency of EPOR in tumor-infiltrating macrophages. $3 \times 10^6$ Epo-over-expressing Hepa1-6 cells were orthotopically implanted in C57BL/6 mice. After one week, mice were treated with liposomes containing 50 µg of either siRNA targeting EPOR (siEpor) or non-target control siRNA (siNTC) via intravenous injection every four days for a total of three doses. Tumors were harvested after 3 weeks post-injection and dissociated into single cell suspension. Macrophages were isolated with magnetic-activated cell sorting and RNA was extracted for real-time PCR quantification.

FIG. 15A shows EPOR expression level analyzed by flow cytometry. CD45$^+$ cancer infiltrating lymphocytes were gated as live-dead aqua-CD45$^+$. Histogram showed EPOR expression on individual myeloid cell subsets. Left: breast cancer. Right: surrounding healthy tissue. Bottom: EPOR expression on dendritic cells gated as CD11c$^+$HLA$^-$DR$^+$CD14$^-$CD16$^-$. FIG. 15B shows EPOR expression on tumor infiltrating lymphocytes of breast cancer left axillary lymph node (LN) metastatic site. Upper: EPOR expression on dendritic cells. Lower: EPOR expression on HLA-DR– cells.

FIG. 16A shows EPOR expression level on liver metastatic site CD45$^+$ tumor-infiltrating lymphocytes analyzed by flow cytometry. CD45$^+$ cancer infiltrating lymphocytes were gated as live-dead aqua-CD45$^+$. Right: EPOR expression on liver metastasis patient peripheral blood samples compared with healthy donor blood. The percentage of EPOR$^+$ cells is shown in red rectangle. FIG. 16B shows percentage of EPOR$^+$ cells in liver metastasis patient blood, healthy donor blood and liver cancer or liver cirrhosis blood. Statistical analysis was done with unpaired two-tailed t test. *P<0.05; P<0.01; *P<0.001 and ****P<0.0001.

FIG. 18A illustrates an experimental scheme of performing heart transplantation on mice, treating mice with TLI/ATS, conducting bone marrow transplantation, checking allogeneic BM chimerism and heart survival. FIG. 18B shows heart graft survival in wild-type and Batf3$^{-/-}$ mice (left) and BM chimerism at day 34 post BM transplant (TX) in wild-type and Batf3$^{-/-}$ mice (right).

FIGS. 19A-19E show TLI/ATS-induced local apoptosis and extramedullary erythropoiesis, coupled with dendritic cell (DC) enrichment and systemic upregulation of EPO. FIG. 19A shows representative images of TUNEL staining on sections of untreated spleens (UNT) and spleens treated with TLI/ATS. FIG. 19B shows cell composition analysis of changes of different cell populations in the untreated spleen (UNT), spleen treated with ATS, spleen treated with TLI, and spleen treated with TLI/ATS. Pie chart shows the average frequencies of indicated populations from one representative experiment (n=4). T cells (TCRβ$^+$CD19$^-$), B cells (TCRβ$^-$CD19$^+$), erythroid progenitors (TER119$^+$CD71$^+$), DCs (CD11c$^{high}$MHCII$_{high}$), CD11b$^+$ myeloid cells are subdivided into LyG$^+$, Ly6C$^+$ and F4/80$^+$ (RPMs, red pulp macrophages). FIG. 19C shows gating strategy of erythroid progenitors with treated and TLI treated spleen. FIG. 19D shows extramedullary erythropoiesis in spleen treated with TLI and bone marrow with TLI. FIG. 19E shows systemic increase of EPO in peripheral blood serum measured by enzyme-linked immunosorbent assay (ELISA).

FIGS. 20A-20H show RNA-seq analysis of CD8α$^+$ cDC1s sorted from TLI/ATS-conditioned vs. untreated (UNT) mice. FIG. 20A. shows a total splenic cell number in mice untreated or treated with TLI/ATS. FIG. 20B shows frequency of CD11c$^{high}$MHCII$^{high}$ DCs in live cells (DAPI$^-$) of mice untreated or treated with TLI/ATS. FIG. 20C shows gating-strategy for CD8α$^+$CD11b$^-$ and CD11b$^+$CD8α$^-$ cDCs (left) and frequency of CD8α$^+$ CD11b– DCs in CD11$^{high}$MHCII$^{high}$ DCs, UNT vs. TLI/AT (right). Representative samples from TLI/AT-conditioned mice are shown. For FIGS. 20A-20C, numbers in plots indicate the percentage of positively stained cells within each gate. Data are mean±s.e.m., *p<0.001 and **p<0.001 determined by unpaired student t-test, number of mice per group as indicated. Results represent one of at least three similar experiments. FIG. 20D is a Principal Component Analysis (PCA) plot showing distinct clustering of CD8α$^+$ DCs, UNT vs. TLI/AT. FIG. 20E shows a heat map representing RNA-seq gene expression of top 30 up-regulated (P≤0.01 and fold change≥log 2) genes in TLI/AT-conditioned vs. UNT group. Biological replicates (n=2, each pooled from 3-5 mice) for each group are shown separately. The heat map was generated from differential expression analysis with DESeq2 based on R studio software. FIG. 20F shows Gene Set Enrichment Analysis (GSEA) analysis using hallmark gene sets in the Molecular Signatures Database (MSigDB) following TLI/AT. NES: normalized enrichment score. FDR: false discovery rate. Right half of the graph: up-regulated pathways. Left half of the graph: down-regulated pathways. FIG. 20G shows real-time PCR of indicated genes in splenic CD8α$^+$ cDC1s and CD11b$^+$ cDC2s. CD8α$^+$ cDC1s (top panel) and CD11b$^+$ cDC2s (bottom panel) were sorted by flow cytometry from (i) UNT, (ii) ATS, (iii) TLI, (iv) TLI/ATS-conditioned mice on the next day of last dose of TLI. Gating strategy is shown in FIG. 20C. Data are mean±S.E.M., *p<0.05, p<0.01, *p<0.001 and ****p<0.001, ns (no significant differences) determined by unpaired student T-test. FIG. 20H shows EPOR expression in CD8α$^+$ cDC1s in UNT, TLI, and TLI/ATS-treated EPORtdT mice. In TLI and TLI/ATS group, spleen was harvested on the next day of last dose of TLI.

FIG. 22A illustrates an experimental scheme of two groups of FoxP3-DTR mice with different treatment of DT. FoxP3-DTR mice were conditioned with TLI/ATS, and DT was administered either on day 3 after allogeneic BM by intravenous (i.v.) injection (Group A; top) or on day 15 after BM chimerism establishment (Group B; bottom). DT was given every 2 days. Bone marrow chimerism was examined on days 14 and 29 in both groups. FIG. 22B shows percentages of donor (MHCI-H2kb)-derived T cells (TCRβ$^+$), B cells (B220$^+$), macrophages (MΦ; CD64$^+$), and granulocytes (Ly6G$^+$) in Group A (left 3 bars in all 4 graphs) and Group B (right 3 bars in all 4 graphs).

FIGS. 23A and 23C show plots for gating strategy of FoxP3$^+$ Tregs in TCR-vα2$^+$ CD4$^+$ OT-II cells. Graphs show the percentages of FoxP3$^+$ Tregs among TCRvα2$^+$CD4+ live OT-II cells from spleen of C57BL/6 (FIG. 23A), mice with Batf3 knockout (KO) (FIG. 23A), mice with hetero-EPOR deleted in dendritic cells (EPOR$^{\Delta CD11c}$) (FIG. 23C) either untreated (UNT) or treated with TLI. FIGS. 23B and 23D show histograms of the expression of FoxP3 in adoptively transferred OT-II cells. Graphs show FoxP3 mean fluorescence intensity (MFIs) or UNT vs. TLI treated C57BL/6 mice or mice with Batf3 KO (FIG. 23B) or EPOR$^{\Delta CD11c}$ mice (FIG. 23D). Data are mean±S.E.M., *p<0.05, p<0.01, *p<0.001 and ****p<0.001, ns (no significant differences) determined by unpaired student T-test, number of mice per group as indicated.

FIGS. 24A-24D show induction of CD4$^+$ FoxP3$^-$ CD73$^+$ folate receptor 4+ (FR4$^+$)anergic T cells upon allo-bone marrow loading and induction is dependent on the presence of Tregs. FIG. 24A shows BM chimerism without (w/o) and with diphtheria toxin (DT) in B cells, T cells, granulocytes, and macrophages (MΦ). DT was injected on day −1 to day 1. FIG. 24B shows analysis of Tregs and anergic T cells for intercellular IFNγ expression on day 5 after allo-BM loading with or without DT. FIG. 24C shows statistical analysis of FIG. 24B. FIG. 24D shows correlation between FoxP3$^+$ Treg frequency (X axis) and CD4$^+$ FoxP3$^-$ CD73$^+$ FR4$^+$ anergic T cell frequency (Y axis). Linear regression was determined by Prism. Data are mean±S.E.M., *p<0.05, **p<0.01,

*p<0.001 and **p<0.001, ns (no significant differences) determined by unpaired student T-test, number of mice per group as indicated.

FIGS. 25A-25C show 5-chloromethylfuorescein diacetate+ (CMFDA$^+$) allogeneic bone marrow uptake by CD8α$^+$ cDC1s following TLI. FIG. 25A is plots showing engulfment of live allogeneic BM cells in recipient CD11$^{high}$MHCII$^{high}$DCs (left) and comparison of the frequencies of CMFDA$^+$ CD8α$^+$ and CD8α$^-$ cDCs among CD11$^{high}$MHCII$^{high}$recipient DCs, 12 hours after BM injection, respectively (right). FIG. 25B shows percentages of CMFDA$^+$ cells in gated CD11$^{high}$MHCII$^{high}$CD8α$^+$ cDC1s that were untreated (UNT) or treated with TLI. FIG. 27C shows CD103 and DEC-205 expression in CD8α$^+$ CMFDA$^+$ cDC1s. UNT (black) with superimposed distribution by TLI (pink).

Figure 26B:
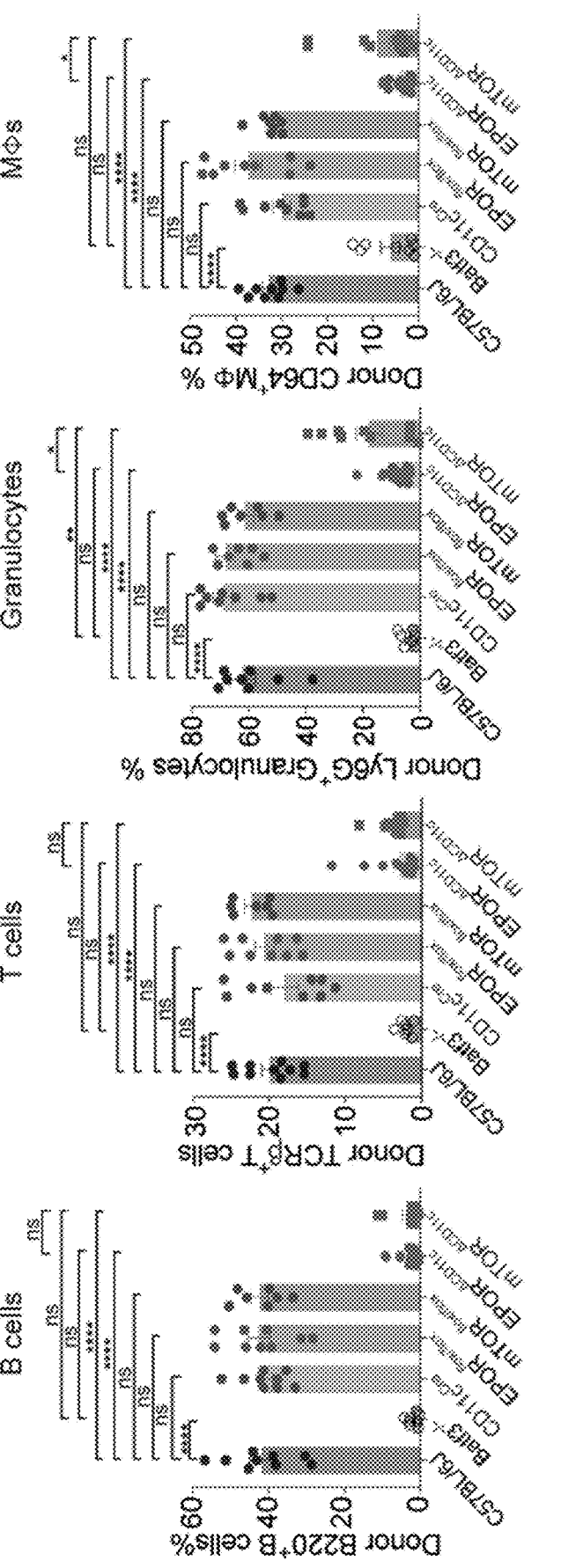

FIGS. 26A-26B illustrates expression of Epo-EPOR downstream signaling molecules in CD8α$^+$ cDC1s and CD11b$^+$ cDC2s and percent of donor cells from various mouse strains. FIG. 26A. shows expression of EPO-EPOR downstream signaling molecules in CD8α$^+$ cDC1s and CD11b$^+$ cDC2s from untreated (UNT) mice, mice treated with TLI, and mice treated with TLI and ATS, as measured by MFI. Intracellular phospho-flow was performed one day after the last dose of TLI. FIG. 26B shows percent of donor cells of B cells, T cells, granulocytes, and macrophages with C57/6J, Batf3$^{-/-}$, CD11c$^{Cre}$, EPOR$^{flox/flox}$, mTOR$^{flox/flox}$ EPOR$^{\Delta XCR1}$, and mTOR$^{\Delta XCR1}$.

FIGS. 27A-27C illustrate the effect of XCR1-specific deletion of EpoR or mTOR on tumor Ag-specific CD8+ T-cells in tumor-draining lymph nodes (tdLN). FIG. 27A illustrates an experimental scheme of analyzing OT-I (CD8+ T-cells expressing T cell antigen receptor) in control mice, mice with EpoR knockout in dendritic cells (EpoR$^{\Delta XCR1}$), and mice with mTOR knockout in dendritic cells (mTOR$^{\Delta XCR1}$). FIG. 27B shows measurement of CD44, SLAMF6, PD-1, and Tim3-expressing cells, and measurement of proliferative cells via flow cytometry. Proliferative cells were measured using a fluorescent dye for cell labeling (CellTrace™ Violet). FIG. 27C shows percentage of proliferated OT-1 in control, EpoR$^{\Delta XCR1}$ mice, and mTOR$^{\Delta XCR1}$ mice. ***P<0.001; ns=not significant.

Figure 28B:
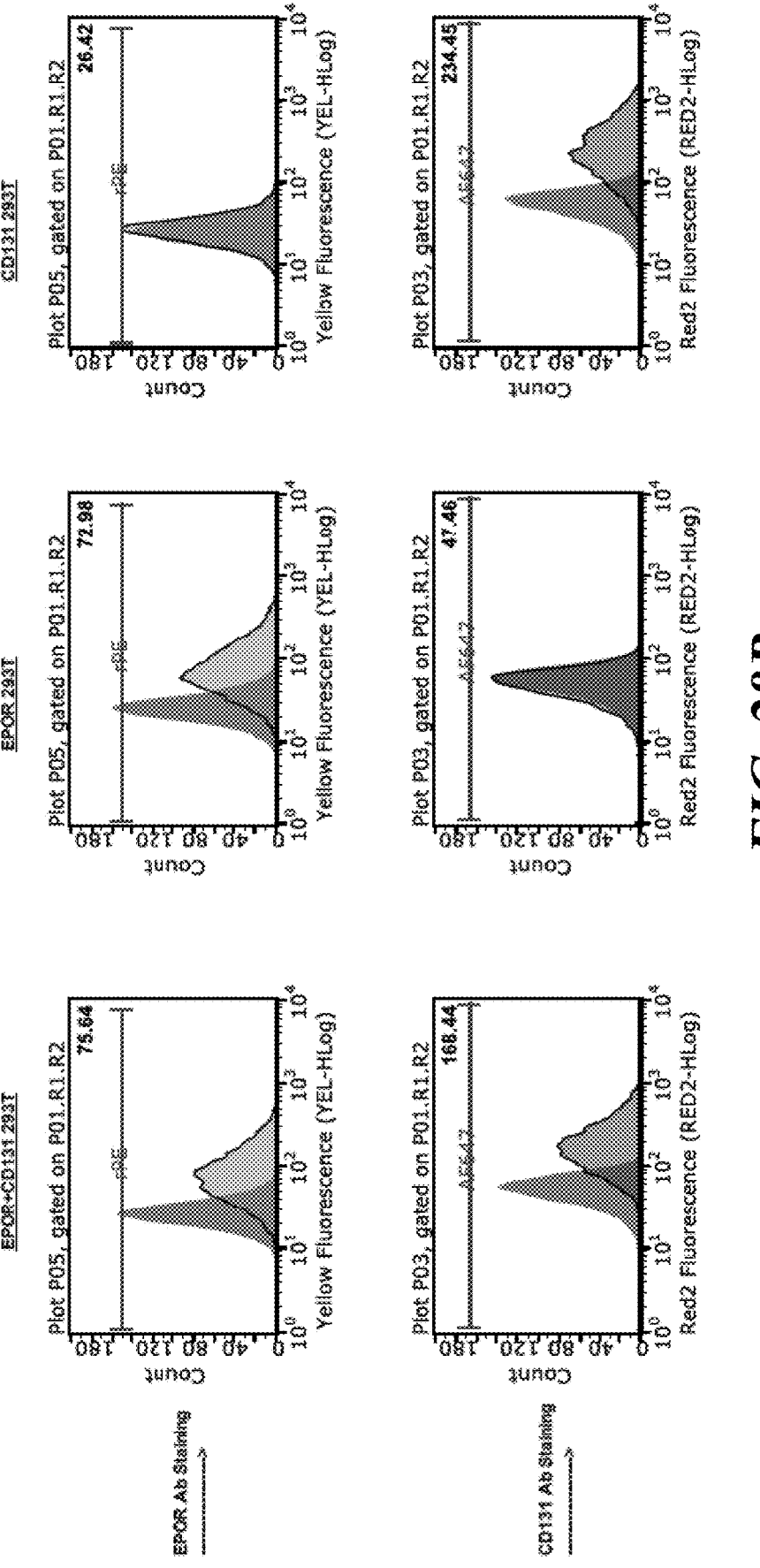

FIGS. 28A-28B illustrate analyses of antibodies in the supernatants of the hybridoma clones. FIG. 28A shows the percentage of cell staining for 293T cells expressing EPOR, CD131, or both, binding kinetics data (EPOR-CD131-Fc, EPOR-Fc, and CD131-Fc), and the data for blocking EPO/ EPOR interaction in percentage for 17 clones with unique antibody sequences. FIG. 28B shows expression of human EPOR (hEPOR) and human CD131 (hCD131) measured by flow cytometry with Phycoerthyrin (PE)-labeled anti-EPOR and Alexa Fluor® 647 (AF647)-labeled anti-CD131, respectively.

Figures 29A, 29B, 29C, 29D:
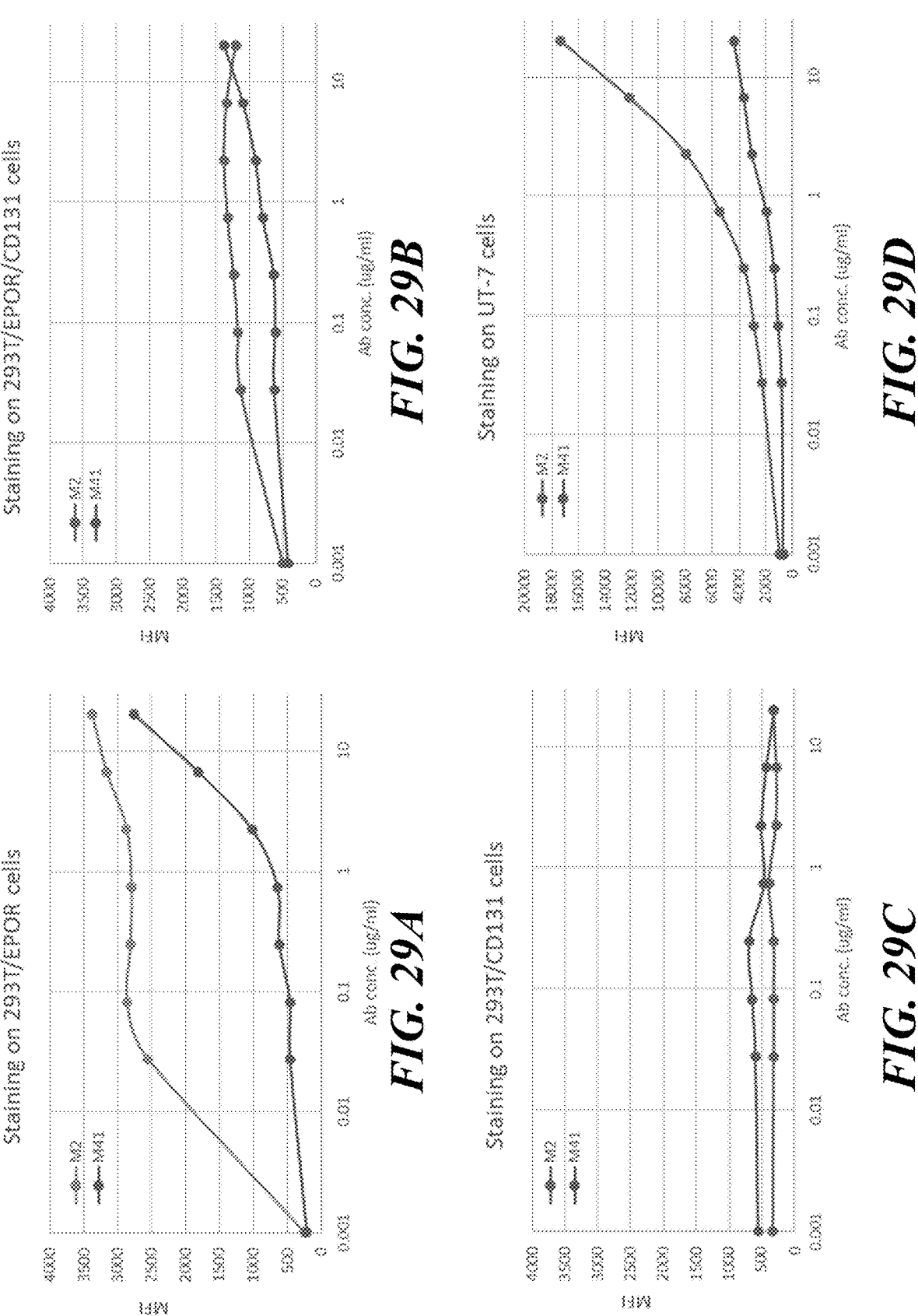

FIGS. 29A-29D illustrate mean or median fluorescence intensity (MFI) of human leukemia UT-7 cells, 293T cells expressing EPOR (293T/EPOR), 293T cells expressing CD131 (293T/CD131), and 293T cells expressing both EPOR and CD131 (293T/EPOR/CD131), stained with purified antibodies. FIG. 29A shows MFI of 293T/EPOR cells labeled with purified hybridoma clones M2 and M41 across different antibody concentrations. FIG. 29B shows MFI of 293T/EPOR/CD131 cells labeled with purified hybridoma clones M2 and M41 across different antibody concentrations. FIG. 29C shows MFI of 293T/CD131 cells labeled with purified hybridoma clones M2 and M41 across different antibody concentrations. FIG. 29D shows MFI of UT-7 cells labeled with purified hybridoma clones M2 and M41 across different antibody concentrations.

Figure 30:
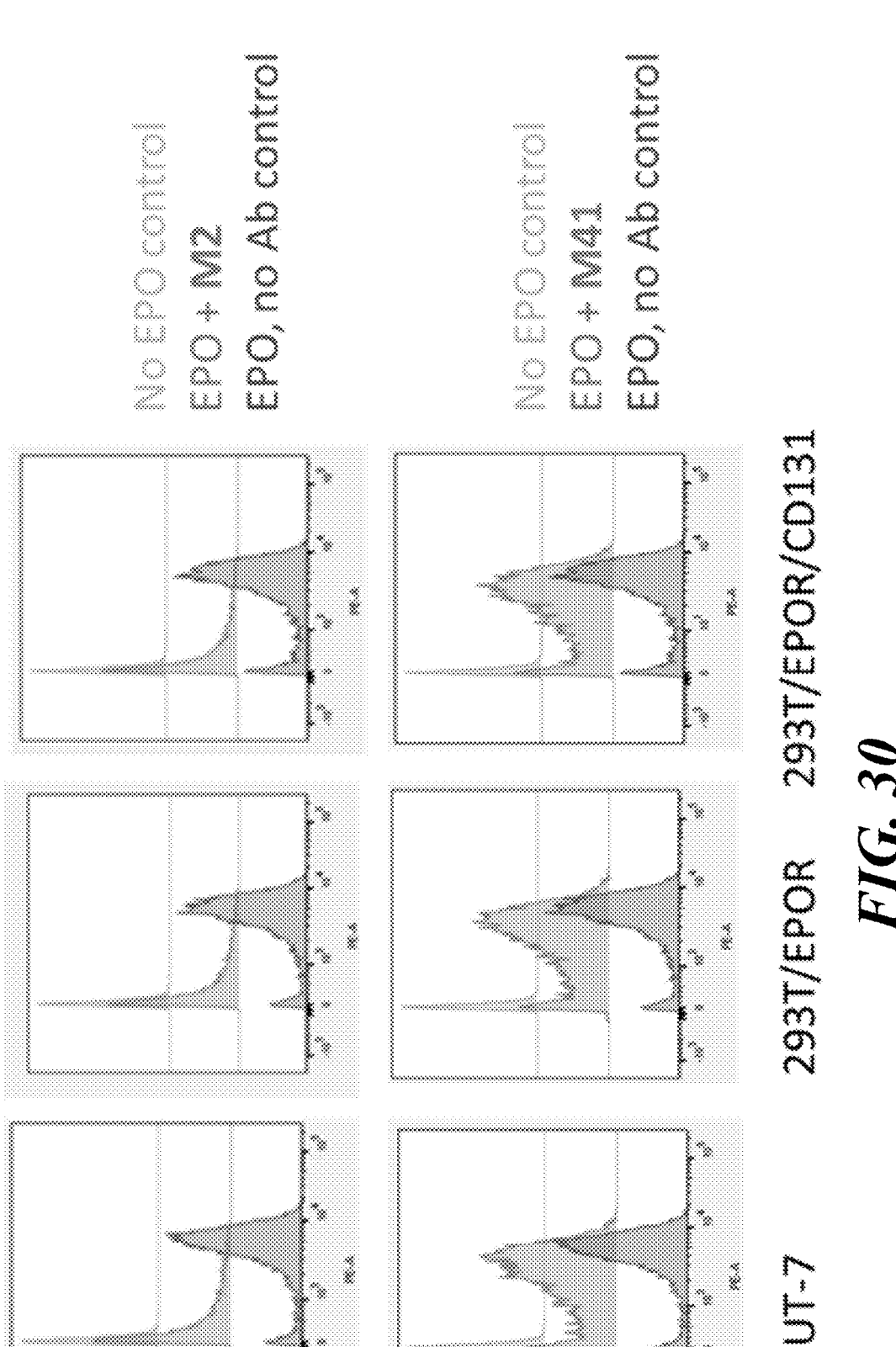

FIG. 30 shows phosphorylated STAT5 analyzed with flow-based assay. UT-7 cells, 293T cells expressing EPOR (293T/EPOR), and 293T cells expressing both EPOR and CD131 (293T/EPOR/CD131) were incubated with anti-EPOR antibody (hybridoma clone M2; top panels or hybridoma clone M41; bottom panels) after stimulation with (EPO+M2 or EPO+M41) or without recombinant human EPO (No EPO control). The same cells without anti-EPOR antibody incubation after EPO stimulation were used as control (EPO, no Ab control).

Figure 31A:
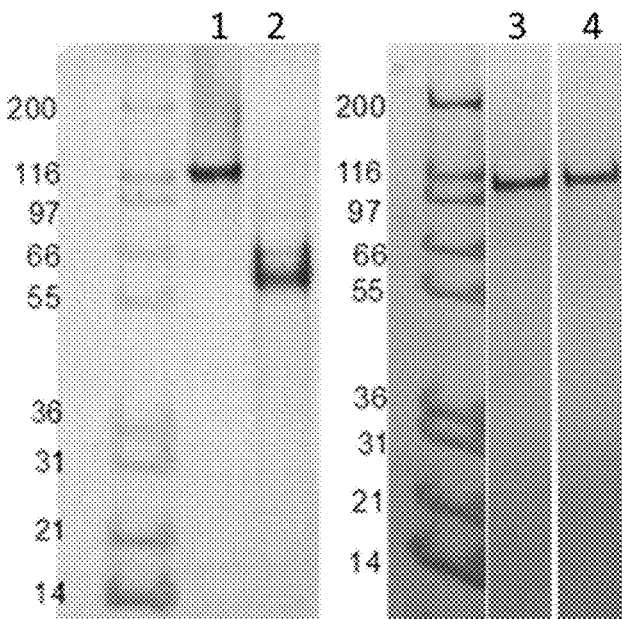
Figure 31B:
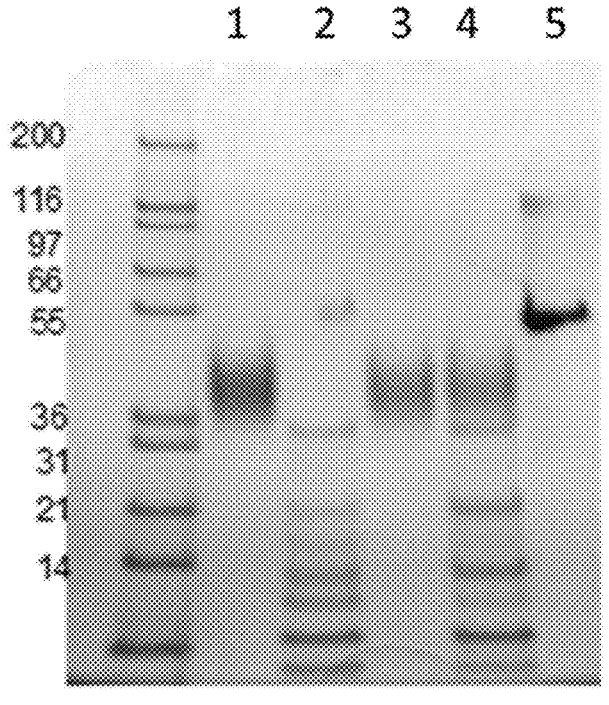

FIGS. 31A-31B illustrate SDS-PAGE analyses of IME001, IME003, IME004, carbamylated EPO (CEPO), and recombinant human EPO (rhEPO). FIG. 31A shows SDS-PAGE of expression vectors IME001 and IME003, which have EPO fused at the N-terminus of human IgG4 or human serum albumin, and of expression vector IME004, which has EPO fused at the C-terminus of human albumin. FIG. 31B shows SDS-PAGE of BSA control, rhEPO with or without Lyc-C digestion, and of CEPO with or without Lyc-C digestion.

Figures 32A, 32B, 32C:
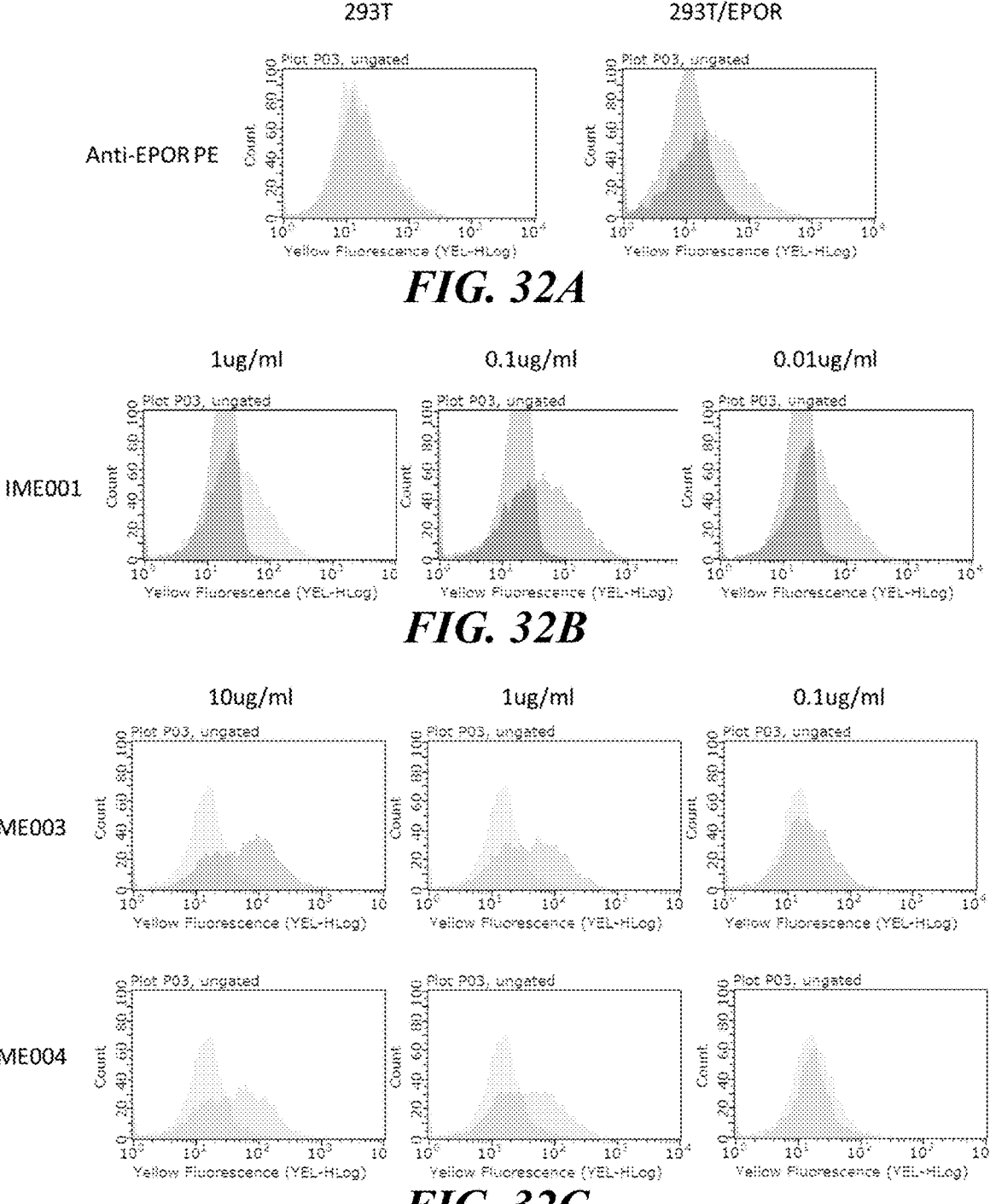
Figures 32D, 33A, 33B:
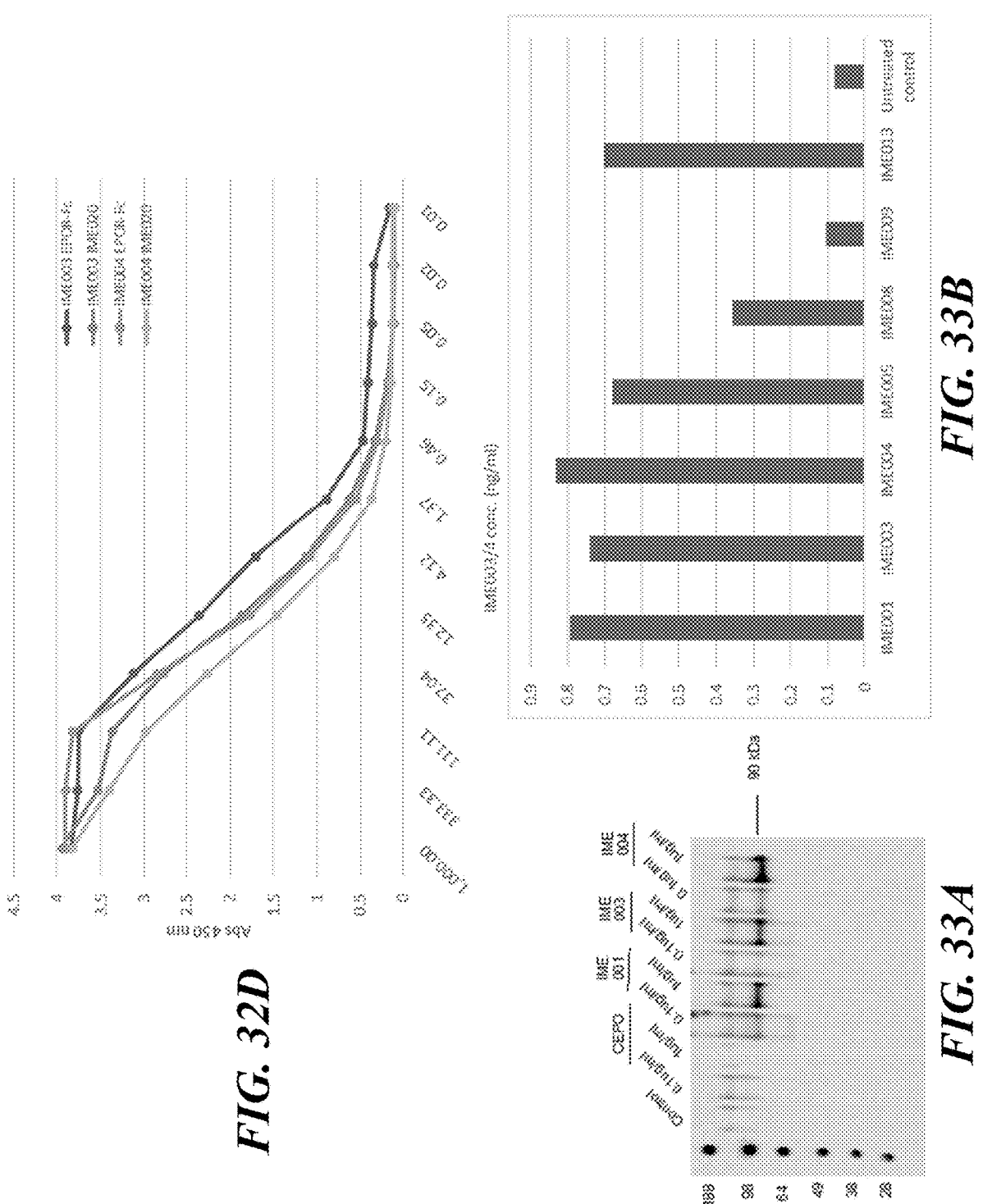

FIGS. 32A-32D illustrate cell staining assay, measuring receptor binding activities of IME001, IME003, and IME004. FIG. 32A shows flow cytometry analysis of 293T cells (left) or 293T/EPOR cells (right) stained with anti-EPOR PE conjugate. FIG. 32B shows flow cytometry analysis of 293T/EPOR cells incubated with 1 μg/ml (left), 0.1 μg/ml (middle), or 0.01 μg/ml (right) of IME001, and stained with anti-human Fc PE conjugate. FIG. 32C shows flow cytometry analysis of 293T/EPOR cells incubated with 10 μg/ml (left), 1 μg/ml (middle), or 0.1 pg/ml (right) of ITME003 (top panel) or IME004 (bottom panel), biotinylated anti-HSA (human serum albumin), and streptavidin PE conjugate. FIG. 32D shows binding of ITME003 EPOR-Fc, IME003 IME 020, IME004 EPOR-Fc, IME004 IME020 at various concentrations of IME003/IME004.

FIGS. 33A-33B illustrate analysis of STAT5 phosphorylation in 293T/EPOR cells stimulated with various EPO proteins. FIG. 33A shows a western blot analysis with human phosphor-STAT5a/b (Y694/Y699) of 293T/EPOR cells untreated (control) or stimulated with CEPO, IME001, IME003, or IME004. FIG. 33B shows result of Phospho-STAT5 enzyme-linked immunosorbent assay (ELISA) with lysate of 293T/EPOR cells untreated (untreated control) or stimulated with IME001, IME003, IME004, IME005, IME008, or IME013.

FIG. 34 illustrates the amino acid sequence (SEQ ID NO: 3889) and nucleic acid sequence (SEQ ID NO: 3888) of human EPO, including the signal peptide sequence.

Figure 35A:
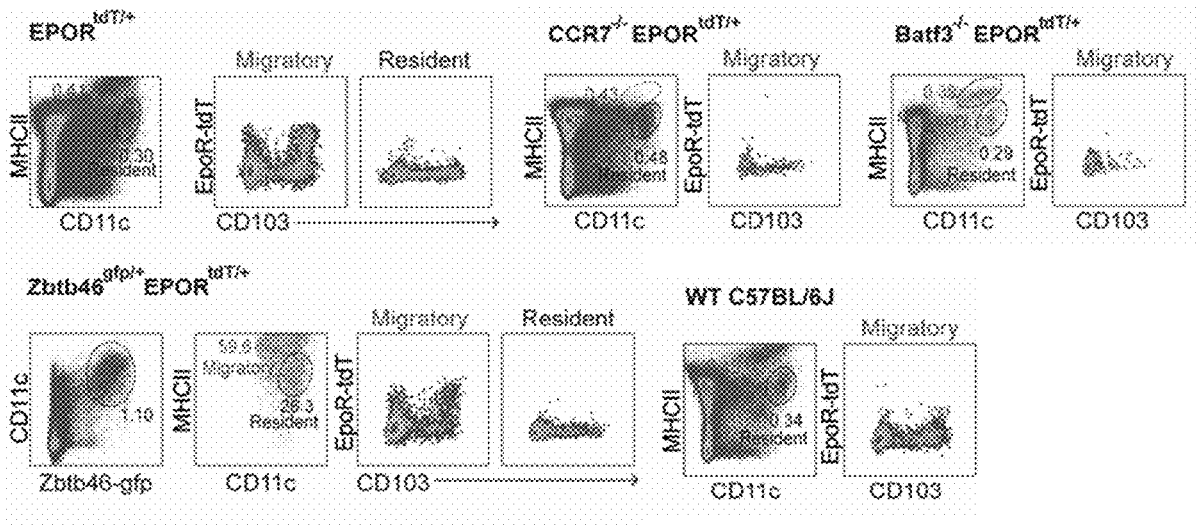
Figure 35B:
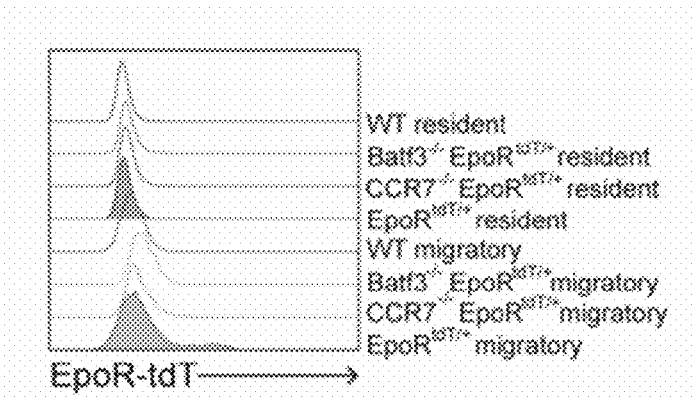
Figure 35C:
Figures 35D, 35E:
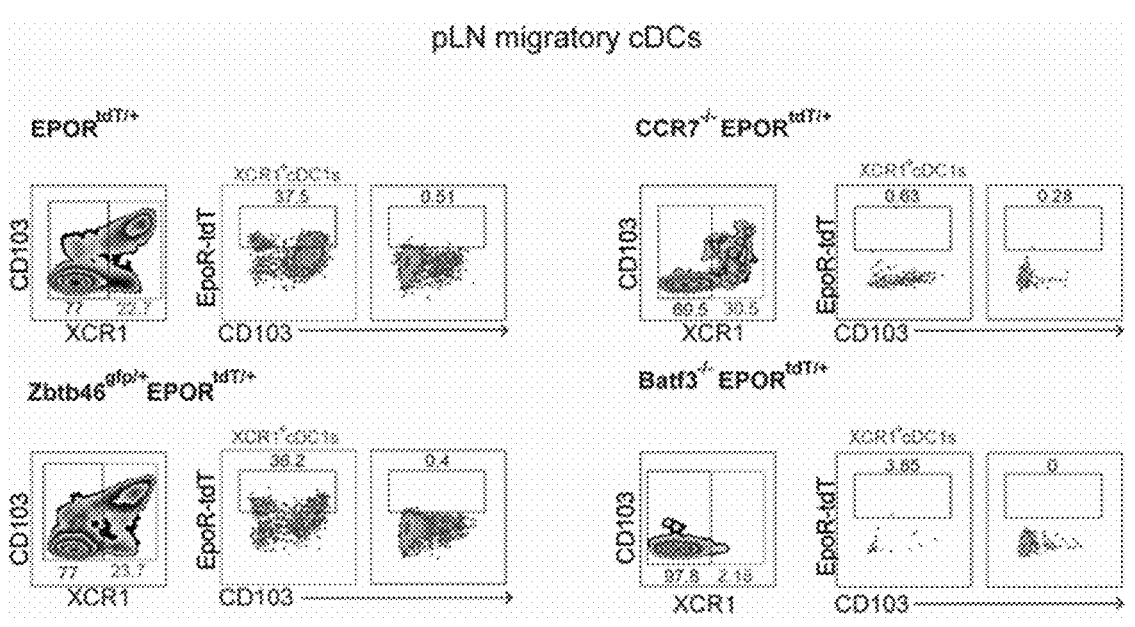

FIGS. 35A-35E illustrate EpoR expression on peripheral lymph node (pLN) migratory cDC1s. FIG. 35A shows flow cytometry analysis of EpoR expression in pLN migratory and resident cDC1s from EpoR$^{tdt/+}$, Zbtb46$^{gfp/+}$EpoR$^{tdT/+}$, CCR7$^{-/-}$EpoR$^{tdT/+}$, and Batf3$^{-/-}$EpoR$^{tdT+}$ mice. FIG. 35B shows histograms of EpoR expression in migratory and resident cDC1s of individual mouse stain. FIG. 35C shows flow analysis of EPOR expression in individual inguinal, axillary, branchial, or superficial cervical lymph nodes. FIG. 35D shows flow cytometry analysis of EPOR and CD103 expression in pLN migratory cDCs. FIG. 35E shows experimental scheme of EpoR$^-$ tdT-cre mice cross bred with Rosa26-lox-Stop-lox-EYFP mice, and flow cytometry analysis of pLN migratory cDC1s (MHCII$_{high}$CD11$^{inter}$XCR1$^+$) for EYFP expression.

Figure 36:
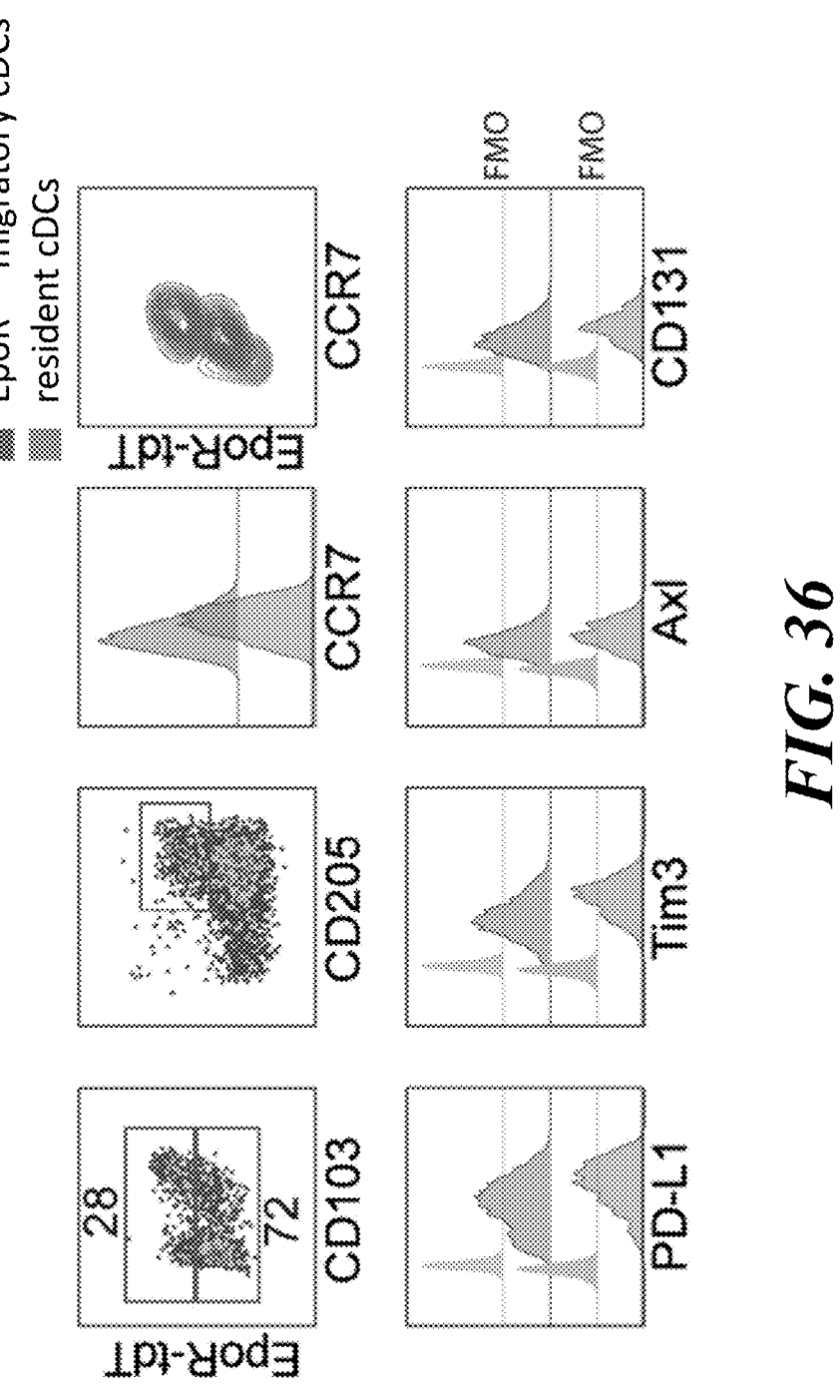

FIG. 36 shows flow cytometry analysis of Peripheral LN migratory EpoR$^+$ XCR1$^+$cDC1s expressing DEC205$^+$ and CCR7$^+$. FIG. 36 also shows histograms comparing of PD-L1, Tim3, Axl and CD131 expression on EpoR$^{high}$ migratory cDC1s with EpoR$^{low}$ migratory cDCs.

Figure 37A:
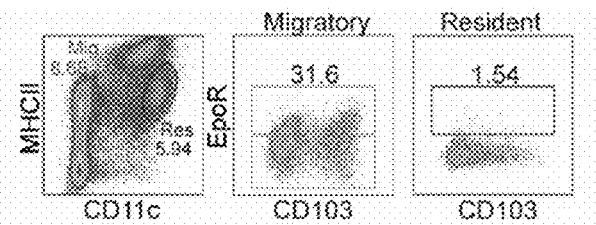
Figure 37B:
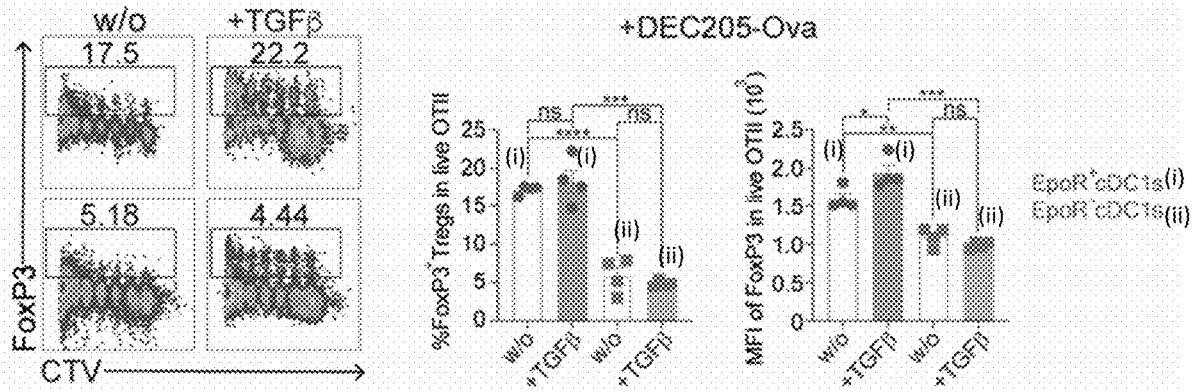
Figure 37C:
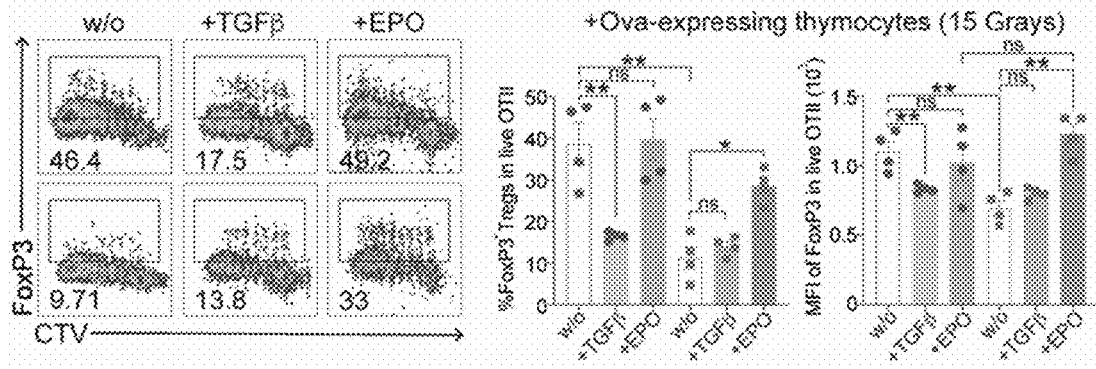

FIGS. 37A-37C illustrate the effect of peripheral LN (pLN) migratory EpoR$^+$XCR1$^+$ cDC1s on inducing Ag-specific Tregs towards DEC205-Ova and Ova-expressing cells. FIG. 37A shows flow cytometry analysis of pLN migratory and resident EpoR$^+$ cDC1s and EpoR$^-$ cDC1s. FIG. 37B shows flow cytometry and quantification of FoxP3 expression of fluorescent dye (CellTrace™ Violet labeled naïve CD45.1$^+$ OT-II cells cultured with CD45.2$^+$ cDC1s, purified macrophages, and DEC-205-Ova, with or without TGFβ treatment. FIG. 37C shows flow cytometry and quantification of FoxP3 expression of fluorescent dye (CellTrace™ Violet) labeled naïve CD45.1$^+$ OT-II cells cultured with CD45.2$^+$ cDC1s, purified macrophages, and Gray irradiated Act-mOVA thymocytes (CD45.2$^+$), with or without TGFβ treatment, or with or without EPO treatment.

Figure 38A:
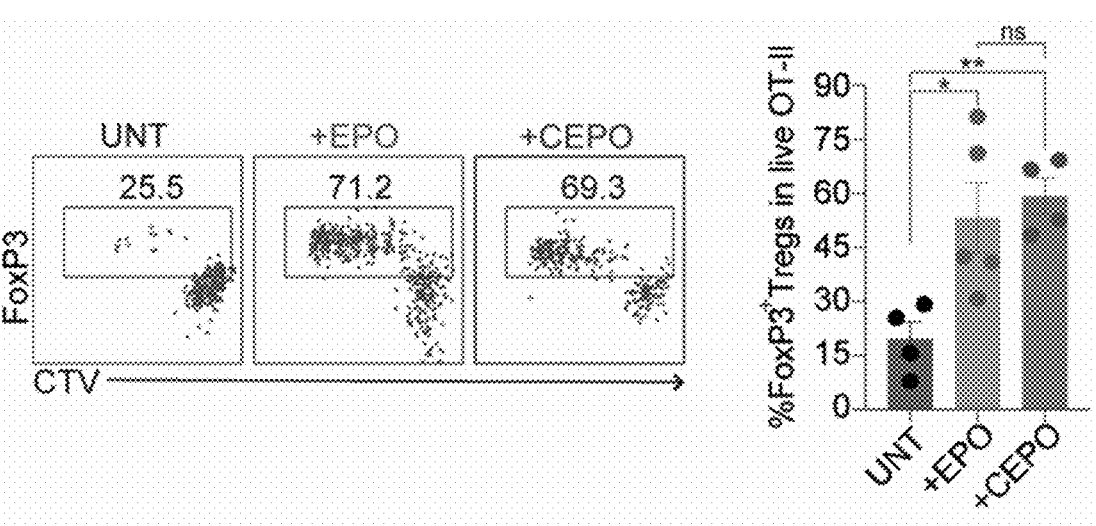
Figure 38B:
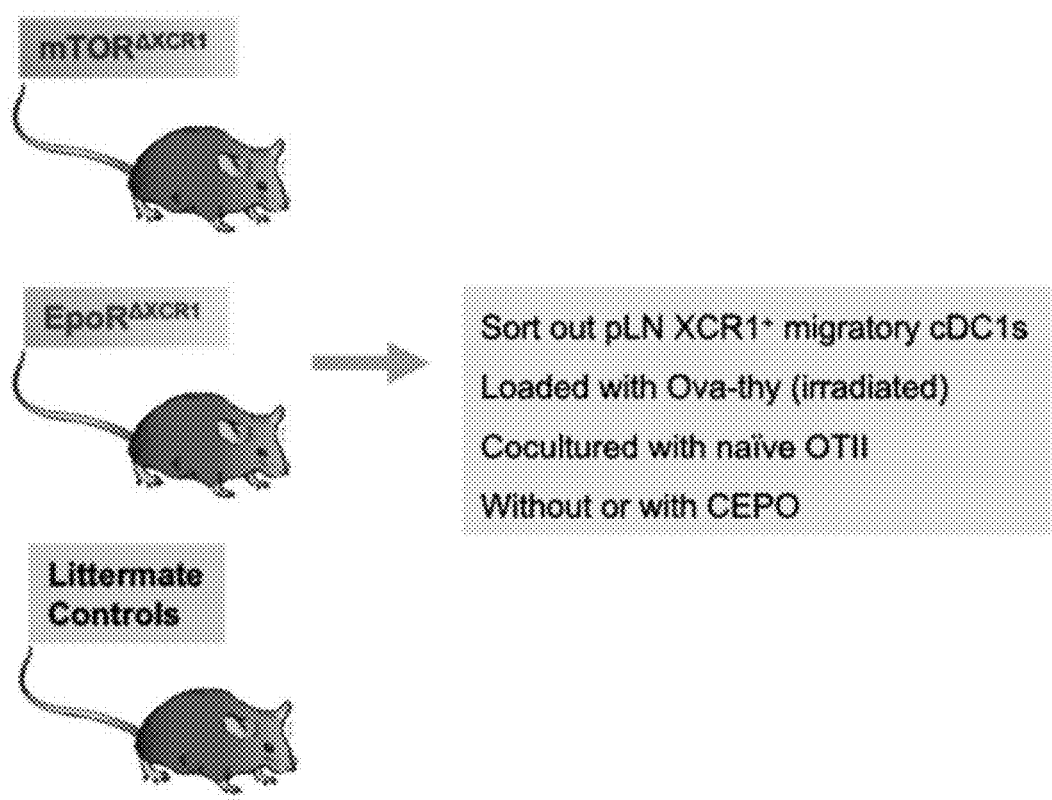

FIGS. 38A-38B illustrate in vitro Antigen (Ag)-specific Regulatory T-cells (Treg) induction with carbomylated EPO (CEPO) treatment. FIG. 38A shows flow cytometry analysis of FoxP3 expression and proliferation of CD11c$^{Int}$MHCII$^{High}$XCR1$^+$cDC1s with EPO or with CEPO treatment using a fluorescent dye for cell labeling (CellTrace™ Violet). FIG. 38A also shows quantification of percent FoxP3+ Tregs in live OT-II untreated (UNT) or with EPO or with CEPO treatment. FIG. 38B shows experimental scheme of studying the effect of EPO or CEPO on antigen-specific tolerance with mice with mTOR knockout in dendritic cells (mTOR$^{ΔXCR1}$), mice with EPOR knockout in dendritic cells (EPOR$^{ΔXCR1}$), and littermate control.

Figure 39A:
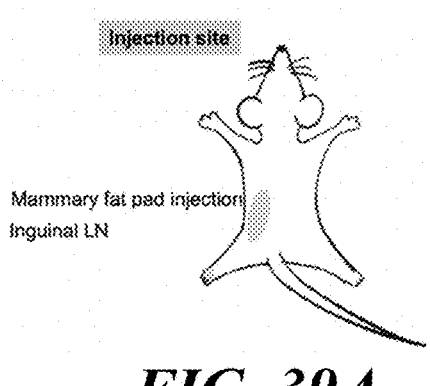
Figure 39B:
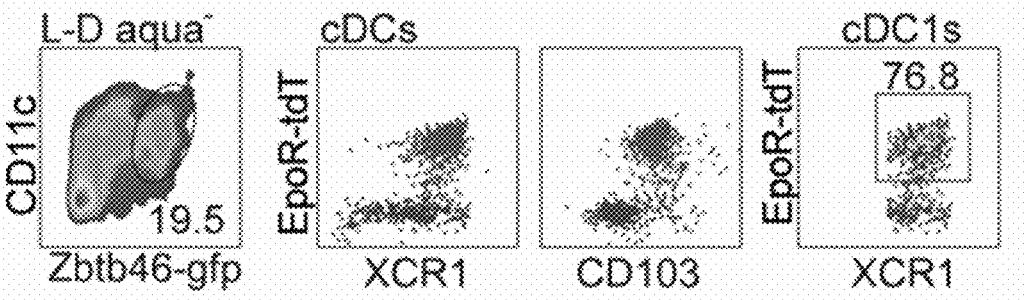
Figure 39C:
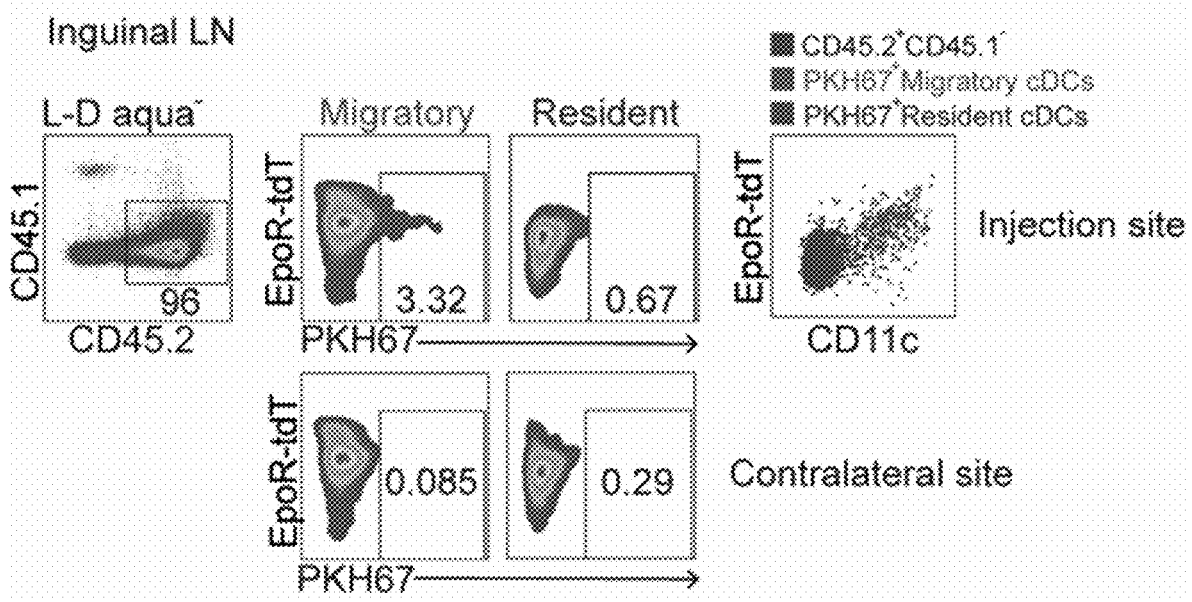

FIGS. 39A-39C illustrate expression of EPOR in migratory cDCs carrying apoptotic cells. FIG. 39A shows experimental scheme of mice injected at the 3$^{rd}$ mammary fat pad with cDC1s. FIG. 39B shows flow cytometry analysis of EPOR expression in 3$^{rd}$ mammary fat pad cDC1s. FIG. 39C shows flow cytometry analysis of EPOR expression in draining lymph node (inguinal LN), injected with PKH67 labeled CD45.1$^+$ dexamethasone (DEX)-induced apoptotic thymocytes.

Figures 40A, 40B:
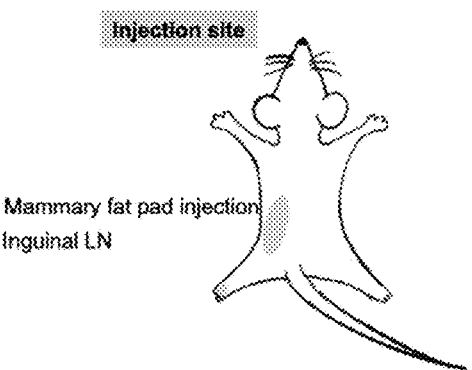

FIGS. 40A-40B illustrate the effect of EPO on peripheral Ag-specific tolerance in the draining lymph nodes towards cell associated Ags (Ova). FIG. 40A shows experimental scheme of injecting i.v. 5×10$^5$ purified macrophages and fluorescent dye (CellTrace™ Violet) labeled naïve CD45.1$^+$ OT-II cells at day −1. At day 0, Dexamethasone (DEX)-induced apoptotic Act-mOVA thymocytes were s.c. injected into the 3$^{rd}$ mammary fat pad. 50 IU EPO was given i.p. for over the course of 4 consecutive days. FIG. 40B shows flow cytometry analysis and quantification of FoxP3 expression in CD45.1$^+$OT-II in the draining lymph node (inguinal LN) with or without EPO.

DETAILED DESCRIPTION OF THE DISCLOSURE

While various embodiments of the present disclosure are described herein, it will be obvious to those skilled in the art that such embodiments are provided by way of example only. Numerous modifications and changes to, and variations and substitutions of, the embodiments described herein will be apparent to those skilled in the art without departing from the disclosure. It is understood that various alternatives to the embodiments described herein can be employed in practicing the disclosure. It is also understood that every embodiment of the disclosure can optionally be combined with any one or more of the other embodiments described herein which are consistent with that embodiment.

Where elements are presented in list format (e.g., in a Markush group), it is understood that each possible subgroup of the elements is also disclosed, and any one or more elements can be removed from the list or group.

It is also understood that, unless clearly indicated to the contrary, in any method described or claimed herein that includes more than one act or step, the order of the acts or steps of the method is not necessarily limited to the order in which the acts or steps of the method are recited, but the disclosure encompasses embodiments in which the order is so limited.

It is further understood that, in general, where an embodiment in the description or the claims is referred to as comprising one or more features, the disclosure also encompasses embodiments that consist of, or consist essentially of, such feature(s).

It is also understood that any embodiment of the disclosure, e.g., any embodiment found within the prior art, can be explicitly excluded from the claims, regardless of whether or not the specific exclusion is recited in the specification.

It is further understood that reference to a peptide, a polypeptide or a protein herein, such as an antibody or a fragment thereof, includes pharmaceutically acceptable salts thereof unless specifically stated otherwise or the context clearly indicates otherwise. Such salts can have a positive net charge, a negative net charge or no net charge.

Headings are included herein for reference and to aid in locating certain sections. Headings are not intended to limit the scope of the embodiments and concepts described in the sections under those headings, and those embodiments and concepts may have applicability in other sections throughout the entire disclosure.

All patent literature and all non-patent literature cited herein are incorporated herein by reference in their entirety to the same extent as if each patent literature or non-patent literature were specifically and individually indicated to be incorporated herein by reference in its entirety.

Beyond erythroid progenitors, a growing body of evidence suggests broad EPOR expression in non-erythroid cells, such as hematopoietic stem cells (HSCs), megakaryocytes, B cells, T cells, macrophages (MΦs), endothelial cells, and neurons (Broxmeyer, J Exp Med 2013:210:205-208). Notably, the immune-modulatory role of EPO is increasingly recognized (Cantarelli et al., Am J Transplant 2019: 19:2407-2414; Peng et al., Cell Death Dis 2020:11:79). The engagement of EPO signaling suppresses inflammatory responses by inhibiting the NFκB inducible immune pathway (Nairz et al., Immunity 2011:34:61-74). Moreover, EPO primes MΦs for effective efferocytosis thereby preventing autoimmunity (Luo et al., Immunity 2016:44:287-302).

EPO is cardioprotective in ischemia reperfusion injury and myocardial infarction. EPO improves cardiac function linked to neovascularization mediated by stimulating coronary endothelial cells to activate endothelial nitric oxide (NO) synthase (eNOS) and NO production (Teng et al., Basic Res. Cardiol. 2011:106:343-354).

EPO stimulates neovascularization and angiogenesis by activating endothelial cells (ECs) and endothelial progenitor cells (EPCs) in physiological conditions and pathological conditions, e.g., ischemia cardio-vascular diseases and tumors. Activation of EPOR leads to mobilization, proliferation, migration, and differentiation of ECs and EPCs (Annese et al., Experimental Cell Research, 2019: 374(2): 266-273).

In the central nervous system, EPO and EPOR are expressed by neurons, glial cells and cerebrovasculature endothelium. EPO was shown to be neurotrophic and neuroprotective in vitro and in animal models of neuronal injury associated with trauma, stroke, ischemia, inflammation and epileptic seizures. The beneficial effects of EPO were also demonstrated in clinical studies of stroke, schizophrenia and progressive multiple sclerosis. EPO protects neurons both directly, by preventing apoptosis, and indirectly, by modulating inflammatory processes and stimulating neurogenesis and angiogenesis (Wang et al., Stroke 2004:35:1732-7).

EPO regulation of metabolism extends beyond oxygen delivery and contributes to maintenance of white adipose tissue and metabolic homeostasis. EPO is protective in diet-induced obesity, improves glucose tolerance, reduces insulin resistance and regulates fat mass accumulation, particularly in male mice (Alnaeeli and Noguchi, Adipocyte 2015:4:153-157). EPO modulates the proinflammatory response of macrophage infiltration in white adipose tissue and promotes an anti-inflammatory phenotype by inhibiting expression of proinflammatory cytokines and reducing macrophage infiltration (Alnaeeli et al., Diabetes Metab. Res. Rev. 2014:63:2415-2431).

It has been shown that some of the cytoprotective effects of EPO are mediated through its binding to heterodimers containing the canonical EPOR and the common beta receptor βcR or CD131; Brines et al., Proc. Natl. Acad. Sci. USA 2004; 101: 14 907-14 912). Interestingly, carbamylated EPO binds to these heteroreceptors and exerts tissue-protective effects, whereas it does not bind to the classical EPOR and does not stimulate erythropoiesis. βcR is not required for erythropoiesis. It is assumed that βcR in combination with the EPOR expressed by nonhematopoietic cells constitutes a tissue-protective receptor, thus creating a tissue-protective heteroreceptor.

The expression levels of EPO and EPOR are regulated. EPO production is induced under hypoxic conditions mediated by HIF (Semenza, Blood 2009:114(10):2015-9). Expression of EPOR is regulated by transcription factors Sp1, GATA1, and TAL1. Binding of EPO to EPOR on erythroid progenitor cells increases expression of transcription factors GATA1 and TAL1, that in turn transactivate EPOR expression (Suresh et al., Front Physiol. 2020:10: 1534). EPOR is also regulated at the protein level. P85 promotes EPOR endocytosis and degradation. Prolyl hydroxylase D3 (PHD3) mediates proline hydroxylation of EPOR leading to proteasomal degradation. TFR2 and Scribble facilitate recycling of EPOR recycling (Bhoopalan et al., F1000Res. 2020; 9: F1000 Faculty Rev-1153).

Figure 2:
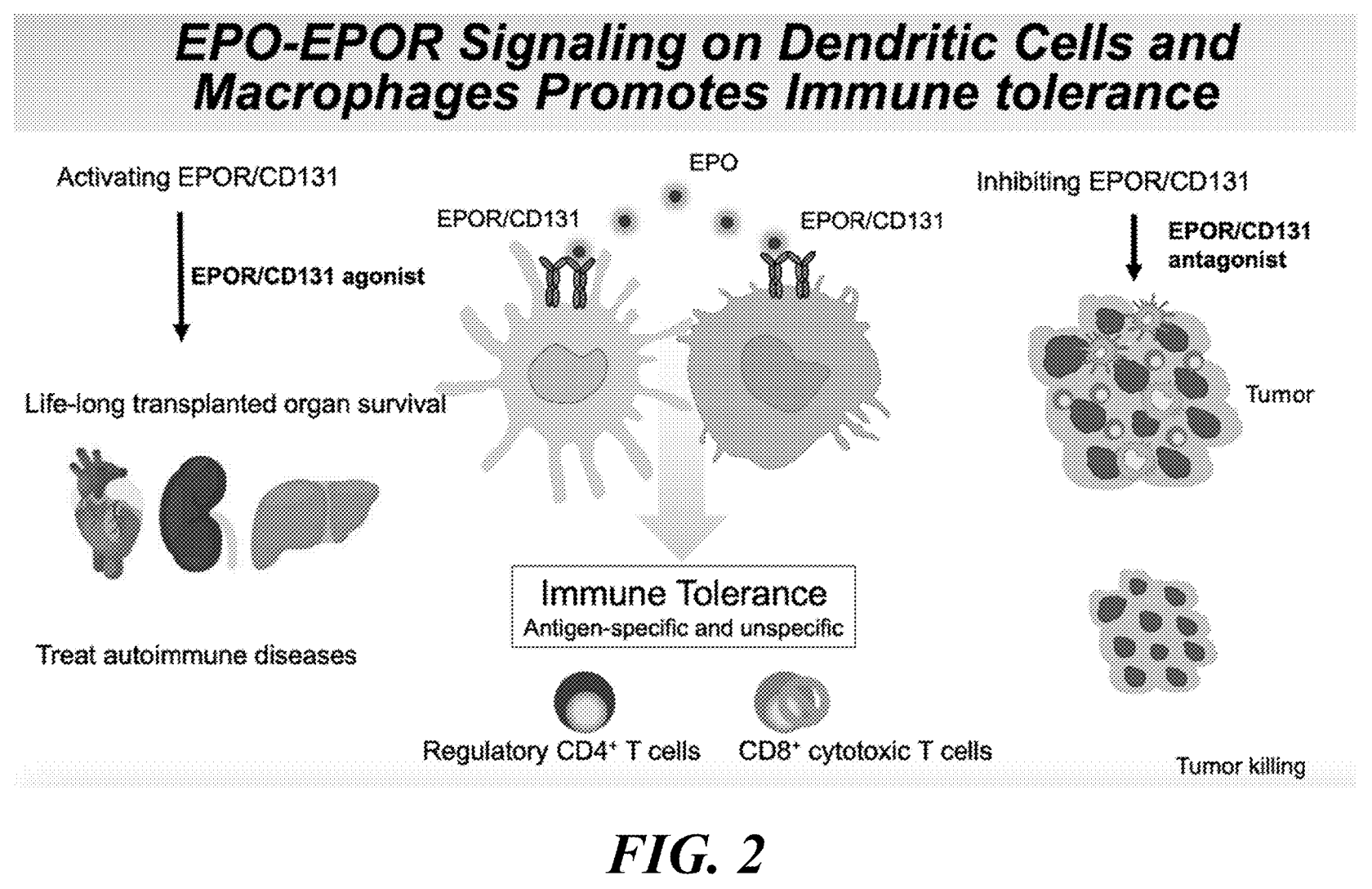

Inventors have recently found that EPOR plays a critical role in the induction of tumor immune tolerance by myeloid cells, including dendritic cells (DCs) and macrophages (MΦs in a wide range of primary and metastatic tumors, including liver metastasis-induced systemic antigen-specific immune tolerance (FIG. 2). Moreover, EPOR is indispensable in myeloid cell-mediated tolerance in transplantation of allogeneic organs such as kidney, liver, lung, heart, etc (FIG. 2).

DEFINITIONS

Unless defined otherwise or clearly indicated otherwise by their use herein, all technical and scientific terms used herein have the same meaning as commonly understood by those of ordinary skill in the art to which this application belongs.

As used in the specification and the appended claims, the indefinite articles "a" and "an" and the definite article "the" can include plural referents as well as singular referents unless specifically stated otherwise or the context clearly indicates otherwise.

The term "about" or "approximately" means an acceptable error for a particular value as determined by one of ordinary skill in the art, which depends in part on how the value is measured or determined. In certain embodiments, the term "about" or "approximately" means within one standard deviation. In some embodiments, when no particular margin of error (e.g., a standard deviation to a mean value given in a chart or table of data) is recited, the term "about" or "approximately" means that range which would encompass the recited value and the range which would be included by rounding up or down to the recited value as well, taking into account significant figures. In certain embodiments, the term "about" or "approximately" means within +10%, 5%, 4%, 3%, 2% or 1% of the specified value. Whenever the term "about" or "approximately" precedes the first numerical value in a series of two or more numerical values or in a series of two or more ranges of numerical values, the term "about" or "approximately" applies to each one of the numerical values in that series of numerical values or in that series of ranges of numerical values.

The term "antibody" can refer to a protein functionally defined as a binding protein and structurally defined as comprising an amino acid sequence that is recognized as being derived from the framework region of an immunoglobulin (Ig) encoding gene. An antibody can comprise one or more polypeptides substantially encoded by immunoglobulin genes or fragments of immunoglobulin genes. The recognized immunoglobulin genes can include the kappa, lambda, alpha, gamma, delta, epsilon and mu constant region genes, as well as myriad immunoglobulin variable region genes. Light chains can be classified as either kappa or lambda. Heavy chains can be classified as gamma, mu, alpha, delta, or epsilon, which in turn define the immunoglobulin classes, IgG, IgM, IgA, IgD and IgE, respectively. In some embodiments, these may be further divided into subclasses (isotypes), e.g., IgG1, IgG2, IgG3, IgG4, IgAQ1 and IgA2.

A typical gamma immunoglobulin (antibody) structural unit is known to comprise a tetramer. Each tetramer can be composed of two identical pairs of polypeptide chains, each pair having one "light" (about 25 kD) and one "heavy" chain (about 50-70 kD). The N-terminus of each chain can define a variable region of about 100 to 110 or more amino acids primarily responsible for antigen recognition. The terms variable light chain ($V_L$) and variable heavy chain ($V_H$) can refer to these light and heavy chains respectively.

Antibodies can exist as intact immunoglobulins or as a number of well-characterized fragments. Thus, for example, pepsin can digest an antibody below the disulfide linkages in the hinge region to produce F(ab)'$_2$, a dimer of Fab' which itself is naturally a light chain joined to VH-CH1-Hinge by a disulfide bond. The F(ab)'$_2$ may be reduced under mild conditions to break the disulfide linkage/s in the hinge region thereby converting the (Fab')$_2$ dimer into an Fab' monomer. The Fab' monomer is essentially a Fab with part of the hinge region (see, Fundamental Immunology, W. E. Paul, ed., Raven Press, N.Y. (1993), for a more detailed description of other antibody fragments). While various antibody fragments are defined in terms of the digestion of an intact antibody, one of skill in the art will appreciate that fragments can be synthesized de novo either chemically or by utilizing recombinant DNA methods. Thus, the term antibody, as used herein can also include antibody fragments either produced by the modification of whole antibodies or synthesized using recombinant DNA methodologies. Preferred antibodies can include $V_H$-$V_L$ dimers, including single chain antibodies (antibodies that exist as a single polypeptide chain), such as single chain Fv antibodies (sFv or scFv) in which a variable heavy and a variable light region are joined together (directly or through a peptide linker) to form a continuous polypeptide. The single chain Fv antibody is a covalently linked $V_H$-$V_L$ heterodimer which may be expressed from a nucleic acid including $V_H$- and $V_L$-encoding sequences either joined directly or joined by a peptide-encoding linker (e.g., Huston, et al. Proc. Natl. Acad. Sci. USA, 85:5879-5883, 1988, which is hereby incorporated by reference in its entirety). While the $V_H$ and $V_L$ are connected to each as a single polypeptide chain, the $V_H$ and $V_L$ domains associate non-covalently. Alternatively, the antibody can be another fragment. Other fragments can also be generated, including using recombinant techniques. For example Fab molecules can be displayed on phage if one of the chains (heavy or light) is fused to g3 capsid protein and the complementary chain exported to the periplasm as a soluble molecule. The two chains can be encoded on the same or on different replicons; the two antibody chains in each Fab molecule assemble post-translationally and the dimer is incorporated into the phage particle via linkage to one of the chains of g3p (see, e.g., U.S. Pat. No. 5,733,743, which is hereby incorporated by reference in its entirety). The scFv antibodies and a number of other structures converting the naturally aggregated, but chemically separated light and heavy polypeptide chains from an antibody V region into a molecule that folds into a three dimensional structure substantially similar to the structure of an antigen-binding site are known to those of skill in the art (see e.g., U.S. Pat. Nos. 5,091,513, 5,132,405, and 4,956,778, all of which are hereby incorporated by reference in their entirety). Particularly preferred antibodies can include all those that have been displayed on phage or generated by recombinant technology using vectors where the chains are secreted as soluble proteins, e.g., scFv, Fv, Fab, (Fab')$_2$. Antibodies can also include diabodies and minibodies.

Antibodies can also include heavy chain dimers, such as antibodies from camelids. Since the $V_H$ region of a heavy chain dimer IgG in a camelid does not have to make hydrophobic interactions with a light chain, the region in the heavy chain that normally contacts a light chain is changed to hydrophilic amino acid residues in a camelid. $V_H$ domains of heavy-chain dimer IgGs are called $V_{HH}$ domains.

In camelids, the diversity of antibody repertoire can be determined by the complementary determining regions (CDR) 1, 2, and 3 in the $V_H$ or $V_{HH}$ regions. The CDR3 in the camel $V_{HH}$ region can be characterized by its relatively long length averaging 16 amino acids (Muyldermans et al., 1994, Protein Engineering 7(9): 1129, which is hereby incorporated by reference in its entirety). This is in contrast to CDR3 regions of antibodies of many other species. For example, the CDR3 of mouse $V_H$ can have an average of 9 amino acids.

Libraries of camelid-derived antibody variable regions, which maintain the in vivo diversity of the variable regions of a camelid, can be made by, for example, the methods disclosed in U.S. Patent Application publication No. US20050037421, published Feb. 17, 2005, which is hereby incorporated by reference in its entirety.

The terms "functional fragments," "antigen-binding portions," "antigen-binding fragments," "antigen-binding domains," or "antibody fragments" can be used interchangeably herein to refer to one or more fragments of an antibody that retain the ability to specifically bind to an antigen. Representative antigen-binding fragments can include, but are not limited to, a Fab, a Fab', a (Fab')$_2$, a Fv, a scFv, a dsFv, a variable heavy domain, a variable light domain, a variable NAR domain, bi-specific scFv, a bi-specific Fab$_2$, a tri-specific Fab$_3$, an AVIMER®, a minibody, a diabody, a maxibody, a camelid, a V$_{HH}$, an intrabody, fusion proteins comprising an antibody portion (e.g., a domain antibody), a single chain binding polypeptide, a scFv-Fc, or a Fab-Fc.

In some instances, an antibody or functional fragment thereof can comprise an isolated antibody or functional fragment thereof, a purified antibody or functional fragment thereof, a recombinant antibody or functional fragment thereof, a modified antibody or functional fragment thereof, or a synthetic antibody or functional fragment thereof. It would be understood that the antibodies described herein can be modified as described herein or as known in the art. In some instances, antibodies and functional fragments thereof described herein can be partly or wholly syntheti- cally produced. An antibody or functional fragment thereof can be a polypeptide or protein having a binding domain which can be or can be homologous to an antigen binding domain. In some instances, an antibody or functional frag- ment thereof can be produced in an appropriate in vivo animal model and then isolated and/or purified.

The term "Fc region" can be used to define a C-terminal region of an immunoglobulin heavy chain. The "Fc region" can be a native sequence Fc region or a variant Fc region. The Fc region of an immunoglobulin generally can comprise two constant domains, CH2 and CH3.

"Antibodies" can include, but are not limited to, mono- clonal antibodies, polyclonal antibodies, chimeric antibod- ies, bispecific antibodies, multispecific antibodies, hetero- conjugate antibodies, humanized antibodies, human antibodies, deimmunized antibodies, mutants thereof, fusions thereof, immunoconjugates thereof, antigen-binding fragments thereof, functional fragments thereof, and/or any other modified configuration of the immunoglobulin mol- ecule that comprises an antigen recognition site of the required specificity, including glycosylation variants of anti- bodies, amino acid sequence variants of antibodies, and/or covalently modified antibodies.

An antibody can be a human antibody. A human antibody can be an antibody having an amino acid sequence corre- sponding to that of an antibody produced by a human and/or has been made using any of the techniques for making human antibodies known in the art or disclosed herein. This definition of a human antibody includes antibodies compris- ing at least one human heavy chain polypeptide or at least one human light chain polypeptide. One such example is an antibody comprising murine light chain and human heavy chain polypeptides. Human antibodies can be produced using various techniques known in the art. In one embodi- ment, the human antibody is selected from a phage library, where that phage library expresses human antibodies (Vaughan et al., 1996, Nature Biotechnology, 14:309-314; Sheets et al., 1998, PNAS USA, 95:6157-6162; Hoogen- boom and Winter, 1991, J. Mol. Biol., 227:381; Marks et al., 1991, J. Mol. Biol., 222:581). Human antibodies can also be made by introducing human immunoglobulin loci into trans- genic animals, e.g., mice in which the endogenous immu- noglobulin genes have been partially or completely inacti- vated. This approach is described in U.S. Pat. Nos. 5,545, 807; 5,545,806; 5,569,825; 5,625,126; 5,633,425; and 5,661,016. Alternatively, the human antibody may be pre- pared by immortalizing human B lymphocytes that produce an antibody directed against a target antigen (such B lym- phocytes may be recovered from a subject or may have been immunized in vitro). See, e.g., Cole et al., Monoclonal Antibodies and Cancer Therapy, Alan R. Liss, p. 77 (1985); Boerner et al., 1991, J. Immunol., 147 (1):86-95; and U.S. Pat. No. 5,750,373.

As used herein, the term "binding specificity" of an antibody or "antibody specificity" can refer to the identity of the antigen to which the antibody binds, preferably to the identity of the epitope to which the antibody binds.

As used herein, the term "chimeric polynucleotide" can mean that the polynucleotide comprises regions which are wild-type and regions which are mutated. It may also mean that the polynucleotide comprises wild-type regions from one polynucleotide and wild-type regions from another related polynucleotide.

As used herein, the term "complementarity-determining region" or "CDR" can refer to the art-recognized term as exemplified by Kabat and Chothia. CDRs are also generally known as hypervariable regions or hypervariable loops (Chothia and Lesk (1987) J Mol. Biol. 196: 901; Chothia et al. (1989) Nature 342: 877; E. A. Kabat et al., Sequences of Proteins of Immunological Interest (National Institutes of Health, Bethesda, Md.) (1987); and Tramontano et al. (1990) J Mol. Biol. 215: 175, all of which are hereby incorporated by reference in their entirety). "Framework region" or "FR" can refer to the region of the V domain that flank the CDRs. The positions of the CDRs and framework regions can be determined using various well known definitions in the art, e.g., Kabat, Chothia, international ImMunoGeneTics data- base (IMGT), and AbM (see, e.g., Johnson et al., supra; Chothia & Lesk, 1987, Canonical structures for the hyper- variable regions of immunoglobulins. J. Mol. Biol. 196, 901-917; Chothia C. et al., 1989, Conformations of immu- noglobulin hypervariable regions. Nature 342, 877-883; Chothia C. et al., 1992, structural repertoire of the human VH segments J. Mol. Biol. 227, 799-817; Al-Lazikani et al., J. Mol. Biol 1997, 273(4)). Definitions of antigen combining sites are also described in the following: Ruiz et al., IMGT, the international ImMunoGeneTics database. Nucleic Acids Res., 28, 219-221 (2000); and Lefranc, M.-P. IMGT, the international ImMunoGeneTics database. Nucleic Acids Res. January 1; 29(1):207-9 (2001); MacCallum et al, Anti- body-antigen interactions: Contact analysis and binding site topography, J. Mol. Biol., 262 (5), 732-745 (1996); and Martin et al, Proc. Natl. Acad. Sci. USA, 86, 9268-9272 (1989); Martin, et al, Methods Enzymol., 203, 121-153, (1991); Pedersen et al, Immunomethods, 1, 126, (1992); and Rees et al, In Sternberg M. J. E. (ed.), Protein Structure Prediction. Oxford University Press, Oxford, 141-172 1996, all of which are hereby incorporated by reference in their entirety).

As used herein, the term "affinity" can refer to the equilibrium constant for the reversible binding of two agents and is expressed as binding affinity (K$_D$). In some cases, K$_D$ can be represented as a ratio of k$_{off}$, which can refer to the rate constant for dissociation of an antibody from the antibody or antigen-binding fragment/antigen complex, to k$_{on}$, which can refer to the rate constant for association of an antibody, an antigen binding domain, or an antigen binding fragment to an antigen. Binding affinity may be determined using methods known in the art including, for example, surface plasmon resonance (SPR; Biacore™, real time molecular interaction monitoring system for analysis of affinity and/or kinetics), KinExA™ Biosensor (system for measuring binding affinity KD), scintillation proximity assays, enzyme linked immunosorbent assay (ELISA), ORI- GEN immunoassay (IGEN), fluorescence quenching, fluorescence transfer, yeast display, or any combination thereof. Binding affinity may also be screened using a suitable bioassay. The binding affinity ($K_D$) of an antibody, antigenbinding domain, or antigen-binding fragment herein can be less than 600 nM, 590 nM, 580 nM, 570 nM, 560 nM, 550 nM, 540 nM, 530 nM, 520 nM, 510 nM, 500 nM, 490 nM, 480 nM, 470 nM, 460 nM, 450 nM, 440 nM, 430 nM, 420 nM, 410 nM, 400 nM, 390 nM, 380 nM, 370 nM, 360 nM, 350 nM, 340 nM, 330 nM, 320 nM, 310 nM, 300 nM, 290 nM, 280 nM, 270 nM, 260 nM, 250 nM, 240 nM, 230 nM, 220 nM, 210 nM, 200 nM, 190 nM, 180 nM, 170 nM, 160 nM, 150 nM, 140 nM, 130 nM, 120 nM, 110 nM, 100 nM, 90 nM, 80 nM, 70 nM, 50 nM, 50 nM, 49 nM, 48 nM, 47 nM, 46 nM, 45 nM, 44 nM, 43 nM, 42 nM, 41 nM, 40 nM, 39 nM, 38 nM, 37 nM, 36 nM, 35 nM, 34 nM, 33 nM, 32 nM, 31 nM, 30 nM, 29 nM, 28 nM, 27 nM, 26 nM, 25 nM, 24 nM, 23 nM, 22 nM, 21 nM, 20 nM, 19 nM, 18 nM, 17 nM, 16 nM, 15 nM, 14 nM, 13 nM, 12 nM, 11 nM, 10 nM, 9 nM, 8 nM, 7 nM, 6 nM, 5 nM, 4 nM, 3 nM, 2 nM, 1 nM, 990 pM, 980 pM, 970 pM, 960 pM, 950 pM, 940 pM, 930 pM, 920 pM, 910 pM, 900 pM, 890 pM, 880 pM, 870 pM, 860 pM, 850 pM, 840 pM, 830 pM, 820 pM, 810 pM, 800 pM, 790 pM, 780 pM, 770 pM, 760 pM, 750 pM, 740 pM, 730 pM, 720 pM, 710 pM, 700 pM, 690 pM, 680 pM, 670 pM, 660 pM, 650 pM, 640 pM, 630 pM, 620 pM, 610 pM, 600 pM, 590 pM, 580 pM, 570 pM, 560 pM, 550 pM, 540 pM, 530 pM, 520 pM, 510 pM, 500 pM, 490 pM, 480 pM, 470 pM, 460 pM, 450 pM, 440 pM, 430 pM, 420 pM, 410 pM, 400 pM, 390 pM, 380 pM, 370 pM, 360 pM, 350 pM, 340 pM, 330 pM, 320 pM, 310 pM, 300 pM, 290 pM, 280 pM, 270 pM, 260 pM, 250 pM, 240 pM, 230 pM, 220 pM, 210 pM, 200 pM, 190 pM, 180 pM, 170 pM, or any integer therebetween.

An antibody can selectively bind to a target if it can bind to a target with greater affinity, avidity, more readily, and/or with greater duration than it binds to other substances. For example, an anti-EPO antibody or functional fragment thereof that selectively binds to an EPO protein is an antibody or functional fragment that can bind this target with greater affinity, avidity, more readily, and/or with greater duration than it binds to a protein that is not an EPO protein.

As used herein, the term "EPO analog" can refer to a polypeptide having modifications of its polypeptide structure, or polypeptides having shorter, longer, and/or different amino acid sequence compared to wild-type human erythropoietin, and all of which bind with high affinity to the hetero-EPOR or the homo-EPOR. EPO analogs may be antagonists or agonists of the hetero-EPOR or homo-EPOR. EPO analogs may block the activity of the hetero-EPOR or the activity of the homo-EPOR. EPO analogs may activate the hetero-EPOR without activating the homo-EPOR. EPO analogs may activate the homo-EPOR without activating the hetero-EPOR. EPO analogs may inhibit the hetero-EPOR without inhibiting the homo-EPOR. EPO analogs may inhibit the homo-EPOR without inhibiting the hetero-EPOR.

Whenever the term "at least" or "greater than" precedes the first numerical value in a series of two or more numerical values, the term "at least" or "greater than" applies to each one of the numerical values in that series of numerical values.

The term "heterologous" can refer to an amino acid or nucleotide sequence that is not naturally found in association with the amino acid or nucleotide sequence with which it is associated.

As used herein, the term "immunotherapy" can refer to particular therapies aimed at modulating immune system components, such as antibodies or immunocytes, or by drugs or other agents that stimulate, inhibit or otherwise modulate the immune system. For example, "immunotherapy" can refer to checkpoint inhibitor therapy, adoptive cell therapy and/or autologous or allogeneic CAR T-cell therapy.

Whenever the term "no more than" or "less than" precedes the first numerical value in a series of two or more numerical values, the term "no more than" or "less than" applies to each one of the numerical values in that series of numerical values.

The term "polynucleotide" can refer to a polymer composed of nucleotide units. Polynucleotides can include naturally occurring nucleic acids, such as deoxyribonucleic acid ("DNA") and ribonucleic acid ("RNA"), as well as nucleic acid analogs. Nucleic acid analogs can include those which contain non-naturally occurring bases, nucleotides that engage in linkages with other nucleotides other than the naturally occurring phosphodiester bond, or/and bases attached through linkages other than phosphodiester bonds. Non-limiting examples of nucleotide analogs can include phosphorothioates, phosphorodithioates, phosphorotriesters, phosphoramidates, boranophosphates, methylphosphonates, chiral-methyl phosphonates, 2-O-methyl ribonucleotides, peptide-nucleic acids (PNAs), and the like. Such polynucleotides can be synthesized, e.g., using an automated DNA synthesizer. The term "nucleic acid molecule" can refer to larger polynucleotides. The term "oligonucleotide" can refer to shorter polynucleotides. In certain embodiments, an oligonucleotide can comprise no more than about 50 nucleotides. It is understood that when a nucleotide sequence is represented by a DNA sequence (i.e., A, T, G, C), this also includes an RNA sequence (i.e., A, U, G, C) in which "U" replaces "T".

The term "polypeptide" can refer to a polymer composed of natural or/and unnatural amino acid residues, naturally occurring structural variants thereof, or/and synthetic non-naturally occurring analogs thereof, linked via peptide bonds. Synthetic polypeptides can be synthesized, e.g., using an automated polypeptide synthesizer. Polypeptides can also be produced recombinantly in cells expressing nucleic acid sequences that encode the polypeptides. The term "protein" can refer to larger polypeptides. The term "peptide" can refer to shorter polypeptides. In certain embodiments, a peptide can comprise no more than about 50, about 40, or about 30 amino acid residues. Polypeptides can include antibodies and fragments thereof. Conventional notation is used herein to portray polypeptide sequences: the left-hand end of a polypeptide sequence is the amino (N)-terminus; the right-hand end of a polypeptide sequence is the carboxyl (C)-terminus.

Polypeptides can include one or more modifications that may be made during the course of synthetic or cellular production of the polypeptide, such as one or more post-translational modifications, whether or not the one or more modifications are deliberate. Modifications can include, without limitation, glycosylation (e.g., N-linked glycosylation and O-linked glycosylation), lipidation, phosphorylation, sulfation, acetylation (e.g., acetylation of the N-terminus), amidation (e.g., amidation of the C-terminus), hydroxylation, methylation, formation of an intramolecular or intermolecular disulfide bond, formation of a lactam between two side chains, formation of pyroglutamate, carbamylation, and ubiquitination. As another example, a polypeptide can be attached to a natural polymer (e.g., a polysaccharide) or a synthetic polymer (e.g., polyethylene glycol [PEG]), lipidated (e.g., acylated with a $C_8$-$C_{20}$ acyl group), or labeled with a detectable agent (e.g., a radionuclide, a fluorescent dye or an enzyme). PEGylation can increase the protease resistance, stability and half-life, increase the solubility and reduce the aggregation of the polypeptide.

The term "conservative substitution" can refer to substitution of an amino acid in a polypeptide with a functionally, structurally or chemically similar natural or unnatural amino acid. In certain embodiments, the following groups each contain natural amino acids that are conservative substitutions for one another:

1) Glycine (Gly/G), Alanine (Ala/A);
2) Isoleucine (Ile/I), Leucine (Leu/L), Methionine (Met/M), Valine (Val/V);
3) Phenylalanine (Phe/F), Tyrosine (Tyr/Y), Tryptophan (Trp/W);
4) Serine (Ser/S), Threonine (Thr/T), Cysteine (Cys/C);
5) Asparagine (Asn/N), Glutamine (Gln/Q);
6) Aspartic acid (Asp/D), Glutamic acid (Glu/E); and
7) Arginine (Arg/R), Lysine (Lys/K), Histidine (His/H).

In further embodiments, the following groups each contain natural amino acids that are conservative substitutions for one another:

1) non-polar: Ala, Val, Leu, Ile, Met, Pro (proline/P), Phe, Trp;
2) hydrophobic: Val, Leu, Ile, Phe, Tyr, Trp;
3) aliphatic: Ala, Val, Leu, Ile;
4) aromatic: Phe, Tyr, Trp, His;
5) uncharged polar or hydrophilic: Gly, Ala, Pro, Ser, Thr, Cys, Asn, Gln, Tyr (tyrosine may be regarded as a hydrophobic amino acid with a polar side group);
6) aliphatic hydroxyl- or sulfhydryl-containing: Ser, Thr, Cys;
7) amide-containing: Asn, Gln;
8) acidic: Asp, Glu;
9) basic: Lys, Arg, His; and
10) small: Gly, Ala, Ser, Cys.

In other embodiments, amino acids may be grouped as set out below:

1) hydrophobic: Val, Leu, Ile, Met, Phe, Trp, Tyr;
2) aromatic: Phe, Tyr, Trp, His;
3) neutral hydrophilic: Gly, Ala, Pro, Ser, Thr, Cys, Asn, Gln;
4) acidic: Asp, Glu; and
5) basic: Lys, Arg, His; and
6) residues that influence backbone orientation: Pro, Gly.

A polypeptide having one or more modifications relative to a parent polypeptide may be called an "analog", "derivative" or "variant" of the parent polypeptide as appropriate.

The disclosure encompasses pharmaceutically acceptable salts of polypeptides, including those with a positive net charge, those with a negative net charge, and those with no net charge.

The term "pharmaceutically acceptable" can refer to a substance (e.g., an active ingredient or an excipient) that is suitable for use in contact with the tissues and organs of a subject without excessive irritation, allergic response, immunogenicity and toxicity, is commensurate with a reasonable benefit/risk ratio, and is effective for its intended use. A "pharmaceutically acceptable" excipient or carrier of a pharmaceutical composition is also compatible with the other ingredients of the composition. The term "Pharmaceutically acceptable" can refer to a material, such as a carrier or diluent, which does not abrogate the biological activity or properties of the compound, and is relatively nontoxic, i.e., the material may be administered to an individual without causing undesirable biological effects or interacting in a deleterious manner with any of the components of the composition in which it is contained. A pharmaceutically acceptable excipient can denote any pharmaceutically acceptable ingredient in a pharmaceutical composition having no therapeutic activity and being non-toxic to the subject administered, such as disintegrators, binders, fillers, solvents, buffers, tonicity agents, stabilizers, antioxidants, surfactants, carriers, diluents, excipients, preservatives or lubricants used in formulating pharmaceutical products. Pharmaceutical compositions can facilitate administration of the compound to an organism and can be formulated in a conventional manner using one or more pharmaceutically acceptable inactive ingredients that facilitate processing of the active compounds into preparations that can be used pharmaceutically. A proper formulation is dependent upon the route of administration chosen and a summary of pharmaceutical compositions can be found, for example, in Remington: The Science and Practice of Pharmacy, Nineteenth Ed (Easton, Pa.: Mack Publishing Company, 1995); Hoover, John E., Remington's Pharmaceutical Sciences, Mack Publishing Co., Easton, Pennsylvania 1975; Liberman, H. A. and Lachman, L., Eds., Pharmaceutical Dosage Forms, Marcel Decker, New York, N.Y., 1980; and Pharmaceutical Dosage Forms and Drug Delivery Systems, Seventh Ed. (Lippincott Williams & Wilkins 1999), herein incorporated by reference. In some embodiments, pharmaceutical compositions can be formulated by dissolving active substances (e.g., EPOR agonists or antagonists described herein) in aqueous solution for injection into disease tissues or disease cells. In some embodiments, pharmaceutical compositions can be formulated by dissolving active substances (e.g., EPOR agonists or antagonists described herein) in aqueous solution for direct injection into disease tissues or disease cells.

The term "stringent hybridization conditions" can refer to hybridizing in 50% formamide at 5×SSC at a temperature of 42° C. and washing the filters in 0.2×0 SSC at 60° C. (1× SSC is 0.15M NaCl, 0.015M sodium citrate.) Stringent hybridization conditions also encompasses low ionic strength and high temperature for washing, for example 0.015 M sodium chloride/0.0015 M sodium citrate/0.1% sodium dodecyl sulfate at 50° C.; hybridization with a denaturing agent, such as formamide, for example, 50% (v/v) formamide with 0.1% bovine serum albumin/0.1% Ficoll/0.1% polyvinylpyrrolidone/50 mM sodium phosphate buffer at pH 6.5 with 750 mM sodium chloride, 75 mM sodium citrate at 42° C.; or 50% formamide, 5× SSC (0.75 M NaCl, 0.075 M sodium citrate), 50 mM sodium phosphate (pH 6.8), 0.1% sodium pyrophosphate, 5×Denhardt's solution, sonicated salmon sperm DNA (50 g/ml), 0.1% SDS, and 10% dextran sulfate at 42° C., with washes at 42° C. in 0.2× SSC (sodium chloride/sodium citrate) and 50% formamide at 55° C., followed by a high-stringency wash consisting of 0.1× SSC containing EDTA at 55° C.

The term "subject" can refer to an animal, including, but not limited to, a mammal, such as a primate (e.g., a human, a chimpanzee or a monkey), a rodent (e.g., a rat, a mouse, a guinea pig, a gerbil or a hamster), a lagomorph (e.g., a rabbit), a swine (e.g., a pig), an equine (e.g., a horse), a canine (e.g., a dog) or a feline (e.g., a cat). Additional examples of mammals can include, but are not limited to, any member of the mammalian class: humans, non-human primates such as chimpanzees, and other apes and monkey species; farm animals such as cattle, horses, sheep, goats, swine; domestic animals such as rabbits, dogs, and cats; laboratory animals including rodents, such as rats, mice and guinea pigs, and the like. In some cases, the mammal is a human. In some instances, the subject is an adult, a child, or an infant. In some cases, the subject may be an animal. In some cases, an animal may comprise human beings and non-human animals. In one embodiment, a non-human animal may be a non-human mammal described herein. In some instances, the subject is a companion animal. In some instances, the subject is a feline, a canine, or a rodent.

The term "substantially homologous" or "substantially identical" in the context of two polypeptides or polynucleotides can refer to two or more sequences or subsequences that have at least about 50%, 60%, 65%, 70%, 75%, 80%, 85%, 90%, 91%, 92%, 93%, 94%, 95%, 96%, 97%, 98%, or 99% amino acid or nucleic acid residue sequence identity, when compared and aligned for maximum correspondence, as measured using a sequence comparison algorithm or by visual inspection. The terms "substantially homologous" or "substantially identical" can mean at least about 70% amino acid or nucleic acid residue identity. The term "substantially homologous" or "substantially identical" can mean at least about 85% amino acid or nucleic acid residue sequence identity. The substantial homology or identity can exist over a region of the sequences that is at least about 20, 30, 40, 50, 100, 150, or 200 residues in length. The sequences can be substantially homologous or identical over the entire length of either or both comparison biopolymers.

Optimal alignment of sequences for comparison can be conducted, e.g., by the local homology algorithm of Smith and Waterman, *Adv. Appl. Math.*, 2:482 (1981); by the homology alignment algorithm of Needleman and Wunsch, *J. Mol. Biol.*, 48:443 (1970); by the search for similarity method of Pearson and Lipman, Proc. *Natl. Acad. Sci. USA*, 85:2444 (1988); by computerized implementations of these algorithms (e.g., GAP, BESTFIT, FASTA, and TFASTA in the Wisconsin Genetics Software Package, Genetics Computer Group, Madison, Wisconsin); or by visual inspection.

One example of a useful algorithm is PILEUP. PILEUP creates a multiple sequence alignment from a group of related sequences using progressive, pairwise alignments to show relationship and percent sequence identity. It also plots a tree or dendogram showing the clustering relationships used to create the alignment. PILEUP uses a simplification of the progressive alignment method of Feng and Doolittle, *J. Mol. Evol.*, 35:351-360 (1987). The method used is similar to the method described by Higgins and Sharp, *CABIOS*, 5:151-153 (1989). The program can align up to about 300 sequences, each having a maximum length of about 5,000 nucleotides or amino acids. The multiple alignment procedure begins with the pairwise alignment of the two most similar sequences, producing a cluster of two aligned sequences. This cluster is then aligned to the next most related sequence or cluster of aligned sequences. Two clusters of sequences are aligned by a simple extension of the pairwise alignment of two individual sequences. The final alignment is achieved by a series of progressive, pairwise alignments. The program is run by designating specific sequences and their amino acid or nucleotide coordinates for regions of sequence comparison and by designating the program parameters. For example, a reference sequence can be compared to other test sequences to determine the percent sequence identity relationship using the following parameters: default gap weight (3.00), default gap length weight (0.10), and weighted end gaps. Another algorithm that is useful for generating multiple alignments of sequences is Clustal W (see, e.g., Thompson et al., *Nucleic Acids Research*, 22:4673-4680 [1994]).

Another example of an algorithm that is suitable for determining percent sequence identity and sequence similarity is the BLAST algorithm, which is described in Altschul et al., *J. Mol. Biol.*, 215:403-410 (1990). Software for performing BLAST analyses is publicly available through the National Center for Biotechnology Information. This algorithm involves first identifying high scoring sequence pairs (HSPs) by identifying short words of length W in the query sequence, which either match or satisfy some positive-valued threshold score T when aligned with a word of the same length in a database sequence. T is referred to as the neighborhood word score threshold (Altschul 1990). These initial neighborhood word hits act as seeds for initiating searches to find longer HSPs containing them. The word hits are then extended in both directions along each sequence for as far as the cumulative alignment score can be increased. Cumulative scores are calculated using, for nucleotide sequences, the parameters M (reward score for a pair of matching residues; always >0) and N (penalty score for mismatching residues; always <0). For amino acid sequences, a scoring matrix is used to calculate the cumulative score. Extension of the word hits in each direction is halted when: the cumulative alignment score falls off by the quantity X from its maximum achieved value; the cumulative score goes to zero or below, due to the accumulation of one or more negative-scoring residue alignments; or the end of either sequence is reached. The BLAST algorithm parameters W, T, and X determine the sensitivity and speed of the alignment. The BLASTN program (for nucleotide sequences) uses as defaults, e.g., a wordlength (W) of 11, an expectation (E) of 10, M=5, N=−4, and a comparison of both strands. For amino acid sequences, the BLASTP program uses as defaults, e.g., a wordlength (W) of 3, an expectation (E) of 10, and the BLOSUM62 scoring matrix (see Henikoff and Henikoff, *Proc. Natl. Acad. Sci. USA*, 89:10915 [1989]).

In addition to calculating percent sequence identity, the BLAST algorithm also performs a statistical analysis of the similarity between two sequences (see, e.g., Karlin and Altschul, *Proc. Natl. Acad. Sci. USA*, 90:5873-5787 [1993]). One measure of similarity provided by the BLAST algorithm is the smallest sum probability [P(N)], which provides an indication of the probability by which a match between two nucleotide or amino acid sequences would occur by chance. In certain embodiments, a polynucleotide is considered similar to a reference sequence if the smallest sum probability in a comparison of the test polynucleotide to the reference polynucleotide is less than about 0.1, 0.01 or 0.001.

A polypeptide can be substantially homologous or identical to a second polypeptide if the two polypeptides differ only by conservative amino acid substitutions. Two nucleic acid sequences can be substantially homologous or identical if the two polynucleotides hybridize to each other under stringent conditions, or under highly stringent conditions, as described herein.

The term "therapeutically effective amount" can refer to an amount of a compound that, when administered to a subject, is sufficient to prevent, reduce the risk of developing, delay the onset of, slow the progression or cause regression of the medical condition being treated, or to alleviate to some extent the medical condition or one or more symptoms or complications of that condition. The term "therapeutically effective amount" can also refer to an amount of a compound that is sufficient to elicit the biological or medical response of a cell, tissue, organ, system, animal or human which is sought by a researcher, veterinarian, medical doctor or clinician.

The terms "treat", "treating" and "treatment" can include alleviating, ameliorating or abrogating a medical condition or one or more symptoms or complications associated with the condition, alleviating, ameliorating or eradicating one or more causes of the condition, preventing additional symptoms, inhibiting the disease or the condition, e.g., arresting the development of the disease or the condition, relieving the disease or the condition, causing regression of the disease or the condition, relieving a condition caused by the disease or the condition, or stopping the symptoms of the disease or the condition either prophylactically and/or therapeutically. In some embodiments, treating a disease or condition cam comprise reducing the size of disease tissues or disease cells. In some embodiments, treating a disease or a condition in a subject can comprise increasing the survival of a subject. In some embodiments, treating a disease or condition can comprise reducing or ameliorating the severity of a disease, delaying onset of a disease, inhibiting the progression of a disease, reducing hospitalization of or hospitalization length for a subject, improving the quality of life of a subject, reducing the number of symptoms associated with a disease, reducing or ameliorating the severity of a symptom associated with a disease, reducing the duration of a symptom associated with a disease, preventing the recurrence of a symptom associated with a disease, inhibiting the development or onset of a symptom of a disease, or inhibiting of the progression of a symptom associated with a disease. In some embodiments, treating a cancer can comprise reducing the size of tumor or increasing survival of a patient with a cancer. Reference to "treatment" of a medical condition can include prevention of the condition. The terms "prevent", "preventing" and "prevention" can include precluding, reducing the risk of developing and delaying the onset of a medical condition or one or more symptoms or complications associated with the condition.

Anti-EPOR, Anti-CD131, and Anti-EPO Antibodies

In some aspects, provided herein, are antibodies, antigen-binding fragments thereof, or functional fragments thereof that can selectively binds to a target. In some embodiments, antibodies, antigen-binding fragments thereof, or functional fragments thereof described herein can bind to an antigen of a target protein or an epitope on an antigen of a target protein.

In some embodiments, an antibody can be a monospecific antibody and binds a single epitope. For example, a monospecific antibody can have a plurality of immunoglobulin variable domain sequences, each of which binds the same epitope. In some embodiments, an antibody can be a bispecific antibody. A bispecific antibody can have specificity for no more than two antigens. A bispecific antibody can be characterized by a first immunoglobulin variable domain sequence which has binding specificity for a first epitope and a second immunoglobulin variable domain sequence that has binding specificity for a second epitope. In some embodiments, the first and second epitopes can be on the same antigen, e.g., the same protein (or subunit of a multimeric protein). In some embodiments, the first and second epitopes can overlap. In some embodiments, the first and second epitopes do not overlap. In some embodiments, the first and second epitopes can be on different antigens, e.g., different proteins (or different subunits of a multimeric protein). In some embodiments, a bispecific antibody can comprise a heavy chain variable domain sequence and a light chain variable domain sequence which have binding specificity for a first epitope and a heavy chain variable domain sequence and a light chain variable domain sequence which have binding specificity for a second epitope. In some embodiments, a bispecific antibody can comprise a half antibody having binding specificity for a first epitope and a half antibody having binding specificity for a second epitope. In some embodiments, a bispecific antibody can comprise a half antibody, or a fragment thereof, having binding specificity for a first epitope and a half antibody, or a fragment thereof, having binding specificity for a second epitope. In some embodiments, a bispecific antibody can comprise a scFv or a Fab, or fragment thereof, have binding specificity for a first epitope and a scFv or a Fab, or fragment thereof, have binding specificity for a second epitope.

In some embodiments, an antibody can be a multispecific or multifunctional antibody. For example, a multispecific or multifunctional antibody can comprise a plurality of immunoglobulin variable domains sequences, wherein a first immunoglobulin variable domain sequence of the plurality has binding specificity for a first epitope and a second immunoglobulin variable domain sequence of the plurality has binding specificity for a second epitope. In some embodiments, the first and second epitopes are on the same antigen, e.g., the same protein (or subunit of a multimeric protein). In some embodiments, the first and second epitopes can overlap. In some embodiments, the first and second epitopes may not overlap. In some embodiments, the first and second epitopes can be on different antigens, e.g., different proteins (or different subunits of a multimeric protein). In some embodiments a multispecific antibody can comprise a third, a fourth or a fifth immunoglobulin variable domain. In some embodiments, a multispecific antibody can be a bispecific antibody, a trispecific antibody, or a tetraspecific antibody. In some embodiments, multispecific antibodies can optionally further comprise one or more additional binding domain(s) that selectively bind(s) to an IgE, a FcεRIa, a FcεRII, a tumor associated antigen (FAA), or a combination thereof Δny bispecific or multispecific antibodies described herein can be isolated, purified, recombinant, synthetic, or any combination thereof. A bispecific or mutispecific antibodies described herein can be made via any suitable method and may be recombinant, synthetic, or a combination thereof. In one aspect, provided herein can be a liquid composition or a lyophilized composition comprising one or more of bispecific or multispecific antibodies described herein. In one embodiment, a composition can comprise a population of a bispecific or multispecific antibodies. In another embodiments, a composition can comprise a population of two, three, four, five, six, seven, eight, nine, ten, or more bispecific or multispecific antibodies described above. A bispecific or multispecific antibodies described herein can be utilized in an in vitro assay to, for example, identify and/or purify one or more tumor cell(s) from a mixed culture (e.g., a biological sample such as a biopsy or a blood sample). A bispecific or multispecific antibodies described herein can be utilized in an in vivo animal model to test the therapeutic efficacy of the bispecific or multispecific antibodies against a tumor.

In some embodiments, an antibody can comprise a diabody, and a single-chain molecule, as well as an antigen-binding fragment of an antibody (e.g., Fab, F(ab')2, and Fv). For example, an antibody molecule can include a heavy (H) chain variable domain sequence (abbreviated herein as VH), and a light (L) chain variable domain sequence (abbreviated herein as VL). In some embodiments, an antibody can comprise a heavy chain and a light chain (referred to herein as a half antibody. In another example, an antibody can comprise two heavy (H) chain variable domain sequences and two light (L) chain variable domain sequence, thereby forming two antigen binding sites, such as Fab, Fab', F(ab')2, Fc, Fd, Fd', Fv, single chain antibodies (scFv for example), single variable domain antibodies, diabodies (Dab) (bivalent and bispecific), and chimeric (e.g., humanized) antibodies, which may be produced by the modification of whole antibodies or those synthesized de novo using recombinant DNA technologies. These functional antibody fragments can retain the ability to selectively bind with their respective antigen. Antibodies and antibody fragments can be from any class of antibodies including, but not limited to, IgG, IgA, IgM, IgD, and IgE, and from any subclass (e.g., IgG1, IgG2, IgG3, and IgG4) of antibodies. A preparation of antibodies can be monoclonal or polyclonal. An antibody can also be a human, humanized, CDR-grafted, or in vitro generated antibody. An antibody can have a heavy chain constant region chosen from, e.g., IgG1, IgG2, IgG3, or IgG4. An antibody can also have a light chain chosen from, e.g., kappa or lambda. The term "immunoglobulin" (Ig) is used interchangeably with the term "antibody" herein.

Non-limiting examples of antigen-binding fragments of an antibody can include: a Fab fragment (a monovalent fragment consisting of the VL, VH, CL and CH1 domains); a F(ab')2 fragment (a bivalent fragment comprising two Fab fragments linked by a disulfide bridge at the hinge region); a Fd fragment consisting of the VH and CH1 domains; a Fv fragment consisting of the VL and VH domains of a single arm of an antibody; a diabody (dAb) fragment consisting of a VH domain; a camelid or camelized variable domain; a single chain Fv (scFv) (see e.g., Bird et al. (1988) Science 242:423-426; and Huston et al. (1988) Proc. Natl. Acad. Sci. USA 85:5879-5883); and a single domain antibody. These antibody fragments can be obtained using conventional techniques known to those with skill in the art, and the fragments can be screened for utility in the same manner as are intact antibodies. For example, a single-chain antibody (scFV) can be engineered (see, for example, Colcher, D. et al. (1999) Ann N Y Acad Sci 880:263-80; and Reiter, Y. (1996) Clin Cancer Res 2:245-52). In some embodiments, a single chain antibody can be dimerized or multimerized to generate multivalent antibodies having specificities for different epitopes of the same target protein. In some embodiments, antibodies can include intact molecules as well as functional fragments thereof. Constant regions of antibodies can be altered or mutated to modify one or more properties of antibodies (e.g., to increase or decrease one or more of: Fc receptor binding, antibody glycosylation, the number of cysteine residues, effector cell function, or complement function). Methods for altering antibody constant regions are known in the art. In some embodiments, antibodies with altered function, e.g., altered affinity for an effector ligand, such as FcR on a cell, or the C1 component of complement can be produced by replacing at least one amino acid residue in the constant portion of the antibody with a different residue (see e.g., EP 388,151 A1, U.S. Pat. Nos. 5,624,821 and 5,648,260, the contents of all of which are hereby incorporated by reference).

In some embodiments, antibodies, antigen-binding fragments thereof, or functional fragments thereof described herein can include a non-antibody scaffold. Non-limiting examples of non-antibody scaffolds include Affibodies, Affilin® molecules, Anticalin® proteins, Atrimers, Avimers, Bicyclic peptides, Cys-knots, Designed Ankyrin Repeat Proteins (DARPins), FN3 scaffolds (e.g., adnectins, centyrins, pronectins, Tn3), Fynomers®, Kunitz domains, or OBodies.

In some embodiments, antibodies, antigen-binding fragments thereof, or functional fragments thereof described herein can be derivatized or linked to another functional molecule (e.g., another peptide or protein). As used herein, a "derivatized" antibody is an antibody that has been modified. Methods of derivatization can include, but are not limited to, the addition of a fluorescent moiety, a radionucleotide, a toxin, an enzyme or an affinity ligand such as biotin. For example, an antibody can be functionally linked to one or more other molecular entities, such as another antibody (e.g., a bispecific antibody or a diabody), a detectable agent, a cytotoxic agent, a pharmaceutical agent, and/or a protein or peptide that can mediate association of the antibody or antibody portion with another molecule (such as a streptavidin core region or a polyhistidine tag) by e.g., chemical coupling, genetic fusion, noncovalent association, or using other methods. One type of derivatized antibody can be produced by crosslinking two or more antibodies (of the same type or of different types, e.g., to create bispecific antibodies). Suitable crosslinkers can include those that are heterobifunctional, having two distinctly reactive groups separated by an appropriate spacer (e.g., m-maleimidobenzoyl-N-hydroxysuccinimide ester) or homobifunctional (e.g., disuccinimidyl suberate). Such linkers are available from Pierce Chemical Company, Rockford, Ill.

In some embodiments, antibodies can also be single domain antibodies. Single domain antibodies can include antibodies whose complementary determining regions are part of a single domain polypeptide. Non-limiting examples can include heavy chain antibodies, antibodies naturally devoid of light chains, single domain antibodies derived from conventional 4-chain antibodies, engineered antibodies and single domain scaffolds other than those derived from antibodies. Single domain antibodies can be any of the art, or any future single domain antibodies. Single domain antibodies can be derived from any species including, but not limited to mouse, human, camel, llama, fish, shark, goat, rabbit, and bovine. In some embodiments, a single domain antibody can be a naturally occurring single domain antibody known as heavy chain antibody devoid of light chains. Such single domain antibodies are disclosed in WO 94/04678, for example. In some embodiments, this variable domain derived from a heavy chain antibody naturally devoid of light chain is known herein as a VHH or nanobody. Such a VHH molecule can be derived from antibodies raised in Camelidae species, for example in camel, llama, dromedary, alpaca and guanaco. Other species besides Camelidae may produce heavy chain antibodies naturally devoid of light chain.

The VH and VL regions can be subdivided into regions of hypervariability, termed "complementarity determining regions" (CDR), interspersed with regions that are more conserved, termed "framework regions" (FR or FW). The extent of the framework region and CDRs has been precisely defined by a number of methods (see, Kabat, E. A., et al. (1991) Sequences of Proteins of Immunological Interest, Fifth Edition, U.S. Department of Health and Human Services, NIH Publication No. 91-3242; Chothia, C. et al. (1987) *J. Mol. Biol.* 196:901-917; and the AbM definition used by Oxford Molecular's AbM antibody modeling software. See, generally, e.g., *Protein Sequence and Structure Analysis of Antibody Variable Domains*. In: Antibody Engineering Lab Manual (Ed.: Duebel, S. and Kontermann, R., Springer-Verlag, Heidelberg). In some embodiments, CDRs can comprise amino acid sequences within antibody variable regions that confer antigen specificity and binding affinity. In some embodiments, antibodies can have three CDRs in each heavy chain variable region (VH-CDR1, VH-CDR2, and VH-CDR3) and three CDRs in each light chain variable region (VL-CDR1, VL-CDR2, and VL-CDR3). In some embodiments, boundaries of amino acid sequences of a given CDR can be determined using any of a number of known schemes, including those described by Kabat et al. (1991), "Sequences of Proteins of Immunological Interest," 5th Ed. Public Health Service, National Institutes of Health, Bethesda, MD ("Kabat" numbering scheme), Al-Lazikani et al., (1997) JMB 273,927-948 ("Chothia" numbering scheme).

Antibodies described herein can be produced recombinantly, for example, using phase display or by using combinatorial methods. Phage display and combinatorial methods for generating antibodies are known in the art (as described in, e.g., Ladner et al. U.S. Pat. No. 5,223,409; Kang et al. International Publication No. WO 92/18619; Dower et al. International Publication No. WO 91/17271; Winter et al. International Publication WO 92/20791; Markland et al. International Publication No. WO 92/15679; Breitling et al. International Publication WO 93/01288; McCafferty et al. International Publication No. WO 92/01047; Garrard et al. International Publication No. WO 92/09690; Ladner et al. International Publication No. WO 90/02809; Fuchs et al. (1991) Bio/Technology 9:1370-1372; Hay et al. (1992) Hum Antibod Hybridomas 3:81-85; Huse et al. (1989) Science 246:1275-1281; Griffths et al. (1993) EMBO J 12:725-734; Hawkins et al. (1992) J Mol Biol 226:889-896; Clackson et al. (1991) Nature 352:624-628; Gram et al. (1992) PNAS 89:3576-3580; Garrad et al. (1991) Bio/Technology 9:1373-1377; Hoogenboom et al. (1991) Nuc Acid Res 19:4133-4137; and Barbas et al. (1991) PNAS 88:7978-7982, the contents of all of which are incorporated by reference herein).

In some embodiments, antibodies described herein can be fully human antibodies (e.g., antibodies made in a mouse which has been genetically engineered to produce antibodies from a human immunoglobulin sequence), or non-human antibodies, e.g., a rodent (mouse or rat), goat, primate (e.g., monkey), or camel antibodies. In some embodiments, non-human antibodies can be rodent antibodies (mouse or rat antibodies). Methods of producing rodent antibodies are known in the art.

In some embodiments, antibodies, antigen-binding fragments thereof, or functional fragments thereof described herein can be humanized antibodies or humanized antigen-binding fragments. As used herein, "humanized" antibodies refer to forms of non-human (e.g., murine) antibodies that are specific chimeric immunoglobulins, immunoglobulin chains, or fragments thereof that contain minimal sequence derived from non-human immunoglobulin. In some embodiments, humanized antibodies can be human immunoglobulins (recipient antibody) in which residues from a complementarity determining region (CDR) of the recipient are replaced by residues from a CDR of a non-human species (donor antibody) such as mouse, rat, or rabbit having the desired specificity, affinity, and biological activity. In some embodiments, humanized antibodies can have at least one or two, but generally all three, recipient CDRs (of heavy and or light immuoglobulin chains) replaced with a donor CDR. In some embodiments, antibodies may be replaced with at least a portion of a non-human CDR or only some of the CDRs may be replaced with non-human CDRs. In some embodiments, a minimal number of CDRs required for binding to the antigen can be replaced. In some embodiments, Fv framework region (FR) residues of the human immunoglobulin are replaced by corresponding non-human residues. Furthermore, humanized antibodies may comprise residues that are found neither in the recipient antibody nor in the imported CDR or framework sequences, but are included to further refine or optimize antibody performance. In general, a humanized antibody can comprise at least one, and typically two, variable domains, in which all or substantially all of the CDR regions correspond to those of a non-human immunoglobulin and all or substantially all of the FR regions are those of a human immunoglobulin consensus sequence. Humanized antibodies optimally also can comprise at least a portion of an immunoglobulin constant region or domain (Fc), typically that of a human immunoglobulin. Antibodies can have Fc regions modified as described in, for example, WO 99/58572. Other forms of humanized antibodies have one or more CDRs (one, two, three, four, five, or six) which are altered with respect to the original antibody, which are also termed one or more CDRs "derived from" one or more CDRs from the original antibody. Humanized antibodies can be produced, for example, by modeling the antibody variable domains and producing the antibodies using genetic engineering techniques, such as CDR grafting or CDR substitution, wherein one, two, or all CDRs of an immunoglobulin chain can be replaced. A description of various techniques for the production of humanized antibodies is found, for example, in U.S. Pat. No. 5,225,539; Morrison et al., (1984) Proc. Natl. Acad. Sci. USA 81:6851-55; Whittle et al., (1987) Prot. Eng. 1:499-505; Co et al., (1990) J. Immunol. 148:1149-1154; Co et al., (1992) Proc. Natl. Acad. Sci. USA 88:2869-2873; Carter et al., (1992) Proc. Natl. Acad. Sci. USA 89:4285-4289; Routledge et al., (1991) Eur. J. Immunol. 21:2717-2725 and PCT Patent Publication Nos. WO 91/09967; WO 91/09968 and WO 92/113831. For example, human monoclonal antibodies can be generated using transgenic mice carrying the human immunoglobulin genes rather than the mouse system. Splenocytes from these transgenic mice immunized with the antigen of interest can be used to produce hybridomas that secrete human mAbs with specific affinities for epitopes from a human protein (see, e.g., Wood et al. International Application WO 91/00906, Kucherlapati et al. PCT publication WO 91/10741; Lonberg et al. International Application WO 92/03918; Kay et al. International Application 92/03917; Lonberg, N. et al. 1994 Nature 368:856-859; Green, L. L. et al. 1994 Nature Genet. 7:13-21; Morrison, S. L. et al. 1994 Proc. Natl. Acad. Sci. USA 81:6851-6855; Bruggeman et al. 1993 Year Immunol 7:33-40; Tuaillon et al. 1993 PNAS 90:3720-3724; Bruggeman et al. 1991 Eur J Immunol 21:1323-1326). In some embodiments, immunocompetent transgenic mice can be used. In some embodiments, immunocompetent transgenic mice can comprise human antibody heavy chains, human antibody light chains, or combinations thereof. In some embodiments, immunocompetent transgenic mice can comprise human antibody heavy chains, human antibody lamda light chains, human antibody kappa light chains or combinations thereof. In some embodiments, one or more specific amino acids can be substituted, deleted, or added in humanized antibodies. Criteria for selecting amino acids from the donor are described in U.S. Pat. No. 5,585,089, e.g., columns 12-16 of U.S. Pat. No. 5,585,089, e.g., columns 12-16 of U.S. Pat. No. 5,585,089, the contents of which are hereby incorporated by reference. Other techniques for humanizing antibodies are described in Padlan et al. EP 519596 A1, published on Dec. 23, 1992.

In some embodiments, antibodies, antigen-binding fragments thereof, or functional fragments thereof described herein can comprise a CDR-grafted scaffold domain. In some embodiments, the scaffold domain can be based on a fibronectin domain, e.g., fibronectin type III domain. In some embodiments, the overall fold of the fibronectin type III (Fn3) domain can be closely related to that of the smallest functional antibody fragment, the variable domain of the antibody heavy chain. There are three loops at the end of Fn3; the positions of BC, DE and FG loops approximately correspond to those of CDR1, 2 and 3 of the VH domain of an antibody. In some embodiments, Fn3 may not have disulfide bonds; and therefore Fn3 can be stable under reducing conditions, unlike antibodies and their fragments (see, e.g., WO 98/56915; WO 01/64942; WO 00/34784). An Fn3 domain can be modified (e.g., using CDRs or hypervariable loops described herein) or varied, e.g., to select domains that bind to an antigen/marker/cell described herein. In some embodiments, a scaffold domain, e.g., a folded domain, can be based on an antibody, e.g., a "minibody" scaffold created by deleting three beta strands from a heavy chain variable domain of a monoclonal antibody (see, e.g., Tramontano et al., 1994, J Mol. Recognit. 7:9; and Martin et al., 1994, EMBO J. 13:5303-5309). In some embodiments, the minibody can be used to present two hypervariable loops. In some embodiments, the scaffold domain can be a V-like domain (see, e.g., Coia et al. WO 99/45110) or a domain derived from tendamistatin, which is a 74 residue, six-strand beta sheet sandwich held together by two disulfide bonds (see, e.g., McConnell and Hoess, 1995, J Mol. Biol. 250:460). For example, the loops of tendamistatin can be modified (e.g., using CDRs or hypervariable loops) or varied, e.g., to select domains that bind to a marker/antigen/cell described herein. Another exemplary scaffold domain is a beta-sandwich structure derived from the extracellular domain of CTLA-4 (see, e.g., WO 00/60070). Other exemplary scaffold domains can include, but are not limited to, T-cell receptors, MHC proteins, extracellular domains (e.g., fibronectin Type III repeats, EGF repeats), protease inhibitors (e.g., Kunitz domains, ecotin, BPTI, and so forth), TPR repeats; trifoil structures, zinc finger domains, DNA-binding proteins, particularly monomeric DNA binding proteins, RNA binding proteins, enzymes, e.g., proteases (particularly inactivated proteases), RNase, chaperones, e.g., thioredoxin, and heat shock proteins; and intracellular signaling domains (such as SH2 and SH3 domains). See, e.g., US 20040009530 and U.S. Pat. No. 7,501,121, incorporated herein by reference. In some embodiments, a scaffold domain can be evaluated and chosen, e.g., by one or more of the following criteria: (1) amino acid sequence, (2) sequences of several homologous domains, (3) 3-dimensional structure, and/or (4) stability data over a range of pH, temperature, salinity, organic solvent, oxidant concentration. In some embodiments, the scaffold domain can be a small, stable protein domain, e.g., a protein of less than 100, 70, 50, 40 or 30 amino acids. The domain may include one or more disulfide bonds or may chelate a metal, e.g., zinc.

In some embodiments, antibodies, antigen-binding fragments thereof, or functional fragments thereof described herein can comprise variable regions, or a portion thereof, e.g., CDRs, generated in a non-human organism (e.g., a rat or mouse). In some embodiments, antibodies, antigen-binding fragments thereof, or functional fragments thereof described herein can be chimeric, CDR-grafted, or humanized antibodies. In some embodiments, antibodies, antigen-binding fragments thereof, or functional fragments thereof described herein can be generated in a non-human organism and modified. For example, antibodies, antigen-binding fragments thereof, or functional fragments thereof generated in a non-human organism (e.g., a rat or mouse) can be modified in the variable frame work or constant region, to decrease antigenicity and/or immunogenicity in humans. In some embodiments, chimeric antibodies can be produced by recombinant DNA techniques known in the art (see Robinson et al., International Patent Publication PCT/US86/02269; Akira, et al., European Patent Application 184,187;

Taniguchi, M., European Patent Application 171,496; Morrison et al., European Patent Application 173,494; Neuberger et al., International Application WO 86/01533; Cabilly et al. U.S. Pat. No. 4,816,567; Cabilly et al., European Patent Application 125,023; Better et al. (1988 Science 240:1041-1043); Liu et al. (1987) PNAS 84:3439-3443; Liu et al., 1987, J. Immunol. 139:3521-3526; Sun et al. (1987) PNAS 84:214-218; Nishimura et al., 1987, Canc. Res. 47:999-1005; Wood et al. (1985) Nature 314:446-449; and Shaw et al., 1988, J. Natl Cancer Inst. 80:1553-1559).

In some embodiments, antibodies, antigen-binding fragments thereof, or functional fragments thereof described herein that can selectively binds to an antigen of a target protein or an epitope on an antigen of a target protein. In some embodiments, the target can comprise an erythropoietin (EPO) protein, an EPO receptor subunit of a homo-EPOR or a hetero-EPOR, a CD131 subunit of a hetero-EPOR, or a combination thereof. In some embodiments, the target can comprise a hetero-EPOR. For example, antibodies, antigen-binding fragments thereof, or functional fragments thereof described herein can selectively binds to a hetero-EPOR comprising a EPO receptor subunit and a CD131 subunit. In this embodiment, antibodies, antigen-binding fragments thereof, or functional fragments thereof described herein can bind to both EPO receptor subunit and CD131 subunit of a hetero-EPOR. In some embodiments, antibodies, antigen-binding fragments thereof, or functional fragments thereof described herein can be non-naturally occurring. In some embodiments, antibodies, antigen-binding fragments thereof, or functional fragments thereof described herein can be isolated and/or purified. In some embodiments, antibodies, antigen-binding fragments thereof, or functional fragments thereof described herein can be used in in vitro assays (e.g., binding assays, functional assays, etc.).

In some embodiments, antibodies or functional fragments thereof described herein can bind to a target and can act as an antagonist. In one example, an anti-EPO antibody can bind an EPO protein and can prevent formation of a complex between an EPO protein and a homo-EPOR. In another example, an anti-EPO antibody can bind an EPO protein and can prevent formation of a complex between an EPO protein and a hetero-EPOR. In yet another example, an anti-EPOR antibody can bind an EPO receptor subunit and can prevent complex formation of a homo-EPOR, complex formation of a hetero-EPOR, complex formation between an EPO protein and a homo-EPOR, or complex formation between an EPO protein and a hetero-EPOR. In yet another example, an anti-CDC131 antibody can bind a CDC131 subunit of a hetero-EPOR and can prevent complex formation of a hetero-EPOR or complex formation between an EPO protein and a hetero-EPOR. In some embodiments, preventing complex formation of a homo-EPOR or complex formation between an EPO protein and a homo-EPOR can lead to prevention of homo-EPOR activation or function. In some embodiments, preventing complex formation of a hetero-EPOR or complex formation between an EPO protein and a hetero-EPOR can lead to prevention of hetero-EPOR activation or function. In some embodiments, an anti-EPO antibody can bind an EPO protein and inhibit or decrease the level of an activity of a homo-EPOR or a hetero-EPOR without affecting binding of the EPO protein to the homo-EPOR or the hetero-EPOR. In some embodiments, an anti-EPOR antibody can bind to an EPO receptor subunit of a homo-EPOR or a hetero-EPOR and inhibit or decrease the level of an activity of the homo-EPOR or the hetero-EPOR without affecting the complex formation of the homo-EPOR or the hetero-EPOR, or complex formation between an EPO protein and the homo-EPOR or an EPO protein and the hetero-EPOR. In some embodiments, an anti-CD131 antibody can bind a CD131 subunit of a hetero-EPOR and inhibit or decrease the level of an activity of the hetero-EPOR without affecting complex formation of the hetero-EPOR or binding of an EPO protein to the hetero-EPOR.

In some embodiments, antibodies or functional fragments thereof described herein can bind to a target and can act as an agonist. In one example, an anti-EPOR antibody can bind an EPO receptor subunit of a homo-EPOR in a manner that mimics the binding of an EPO to a homo-EPOR. In another example, an anti-EPOR antibody can bind a EPO receptor subunit of a hetero-EPOR in a manner that mimics the binding of an EPO to a hetero-EPOR. In yet another example, an anti-CD131 antibody can bind a CD131 subunit of a hetero-EPOR in a manner that mimics the binding of an EPO to a hetero-EPOR. In some embodiments, mimicking the binding of an EPO to a homo-EPOR can lead to activation of the homo-EPOR. In some embodiments, mimicking the binding of an EPO to a hetero-EPOR can lead to activation of the hetero-EPOR. In some embodiments, an anti-EPO antibody can promote or increase an activity of a homo-EPOR or a hetero-EPOR without affecting the binding affinity of the EPO protein to the homo-EPOR or the hetero-EPOR. In some embodiments, an anti-EPOR antibody can promote or increase an activity of a homo-EPOR or a hetero-EPOR without affecting the binding affinity of the EPO protein to the homo-EPOR or the hetero-EPOR, or the binding affinity of the homo-EPOR (e.g., between the two EPO receptor subunits of the homo-EPOR) or the hetero-EPOR (e.g., between the EPO receptor subunit and CD131 subunit of the hetero-EPOR). In some embodiments, an anti-CD131 antibody can promote or increase an activity of a hetero-EPOR without affecting the binding affinity of the EPO protein to the hetero-EPOR or the binding affinity of the hetero-EPOR (e.g., between the EPO receptor subunit and CD131 subunit of the hetero-EPOR).

In some embodiments, a homo-EPOR activity or a hetero-EPOR activity can include, but are not limited to, phosphorylation of an intracellular domain of a homo-EPOR, a hetero-EPOR, Janus tyrosine kinase 2 (Jak2), or Signal transducer and activator of transcription 5 (Stat5). In some embodiments, a homo-EPOR activity or a hetero-EPOR activity can include, but are not limited to, activation of Jak2, Jak2 pathway, Stat5 pathway, mitogen-activated protein kinase (MAPK), MAPK pathway, extracellular signal-regulated kinase (ERK), ERK pathway, phosphatidylinositol 3-kinase (PI3K), PI3K pathway, v-Akt Murine Thymoma Viral Oncogene/Protein Kinase-B (Akt/PKB), Akt/PKB pathway, Mammalian Target of rapamycin (mTOR), or mTOR pathway. In some embodiments, antibodies or functional fragments thereof described herein can inhibit activation or phosphorylation of homo-EPOR, hetero-EPOR, Jak2, Stat5, MAPK, ERK, PI3K, Akt/PKB, or mTOR. In some embodiments, antibodies or functional fragments thereof described herein can inhibit activation of Jak2, Jak2 pathway, Stat5, Stat5 pathway, MAPK, MAPK pathway, ERK, ERK pathway, PI3K, PIK3 pathway, Akt/PKB, Akt/PKB pathway, mTOR, or mTOR pathway. In some embodiments, antibodies or functional fragments thereof described herein can promote activation or phosphorylation of homo-EPOR, hetero-EPOR, Jak2, Stat5, or mTOR. In some embodiments, antibodies or functional fragments thereof described herein can promote activation of Jak2, Jak2 pathway, Stat5, Stat5 pathway, MAPK, MAPK pathway, ERK, ERK pathway, PI3K, PIK3 pathway, Akt/PKB, Akt/PKB pathway, mTOR, or mTOR pathway. In some embodiments, antibodies or functional fragments thereof described herein may not affect activation or phosphorylation of homo-EPOR, hetero-EPOR, Jak2, Stat5, MAPK, ERK, PI3K, Akt/PKB, or mTOR. In some embodiments, antibodies or functional fragments thereof described herein may not affect activation of Jak2, Jak2 pathway, Stat5, Stat5 pathway, MAPK, MAPK pathway, ERK, ERK pathway, PI3K, PIK3 pathway, Akt/PKB, Akt/PKB pathway, mTOR, or mTOR pathway. In some embodiments, activation or phosphorylation of homo-EPOR, hetero-EPOR, Jak2, Stat5, MAPK, ERK, PI3K, Akt/PKB, or mTOR can be measured using any methods known in the art. Examples of methods to measure Jak2, Stat5, MAPK, ERK, PI3K, Akt/PKB, or mTOR activation level include, but are not limited to, western blotting, a flow cytometry assay, a cell proliferation assay, an apoptosis assay, or enzyme-linked immunosorbant assay (ELISA).

In some embodiments, anti-EPO antibodies, anti-EPOR antibodies, or functional fragments thereof described herein can bind to a target and can act as agonists for hetero-EPOR. In some embodiments, anti-EPO antibodies, anti-EPOR antibodies, or functional fragments thereof described herein can be agonists for hetero-EPOR and can selectively bind to hetero-EPOR. In some embodiments, anti-EPO antibodies, anti-EPOR antibodies, or functional fragments thereof can be agonists for hetero-EPOR and can have a higher binding affinity to hetero-EPOR than to homo-EPOR. In some embodiments, anti-EPO antibodies, anti-EPOR antibodies, or functional fragments thereof described herein can be agonists for hetero-EPOR and can have a hetero-EPOR binding affinity that is at least about 1%, at least about 2%, at least about 3%, at least about 4%, at least about 5%, at least about 6%, at least about 7%, at least about 8%, at least about 9%, at least about 10%, at least about 11%, at least about 12%, at least about 13%, at least about 14%, at least about 15%, at least about 16%, at least about 17%, at least about 18%, at least about 19%, at least about 20%, at least about 21%, at least about 22%, at least about 23%, at least about 24%, at least about 25%, at least about 26%, at least about 27%, at least about 28%, at least about 29%, at least about 30%, at least about 31%, at least about 32%, at least about 33%, at least about 34%, at least about 35%, at least about 36%, at least about 37%, at least about 38%, at least about 39%, at least about 40%, at least about 41%, at least about 42%, at least about 43%, at least about 44%, at least about 45%, at least about 46%, at least about 47%, at least about 48%, at least about 49%, at least about 50%, at least about 55%, at least about 60%, at least about 65%, at least about 70%, at least about 75%, at least about 80%, at least about 85%, at least about 90%, at least about 95%, or at least about 99% higher than a homo-EPOR binding affinity.

In some embodiments, anti-EPO antibodies, anti-EPOR antibodies, or functional fragments thereof can be agonists for hetero-EPOR and can have binding specificity or selectivity for a hetero-EPOR. In some embodiments, anti-EPO antibodies, anti-EPOR antibodies, or functional fragments thereof can be agonists for hetero-EPOR and can have a higher specificity or selectivity to hetero-EPOR than to homo-EPOR. For example, anti-EPO antibodies, anti-EPOR antibodies, or functional fragments thereof can be agonists for hetero-EPOR and can have a hetero-EPOR binding specificity or selectivity that is higher than a homo-EPOR binding specificity or selectivity. In some embodiments, anti-EPO antibodies, anti-EPOR antibodies, or functional fragments thereof described herein can be agonists for hetero-EPOR and have a hetero-EPOR binding specificity or selectivity that is at least about 1%, at least about 2%, at least about 3%, at least about 4%, at least about 5%, at least about 6%, at least about 7%, at least about 8%, at least about 9%, at least about 10%, at least about 11%, at least about 12%, at least about 13%, at least about 14%, at least about 15%, at least about 16%, at least about 17%, at least about 18%, at least about 19%, at least about 20%, at least about 21%, at least about 22%, at least about 23%, at least about 24%, at least about 25%, at least about 26%, at least about 27%, at least about 28%, at least about 29%, at least about 30%, at least about 31%, at least about 32%, at least about 33%, at least about 34%, at least about 35%, at least about 36%, at least about 37%, at least about 38%, at least about 39%, at least about 40%, at least about 41%, at least about 42%, at least about 43%, at least about 44%, at least about 45%, at least about 46%, at least about 47%, at least about 48%, at least about 49%, at least about 50%, at least about 55%, at least about 60%, at least about 65%, at least about 70%, at least about 75%, at least about 80%, at least about 85%, at least about 90%, at least about 95%, or at least about 99% higher than a homo-EPOR binding specificity or selectivity.

In some embodiments, anti-EPO antibodies, anti-EPOR antibodies, or functional fragments thereof described herein can bind to a target and can act as antagonists for hetero-EPOR. In some embodiments, anti-EPO antibodies, anti-EPOR antibodies, or functional fragments thereof described herein can be antagonists for hetero-EPOR and can selectively bind to hetero-EPOR. In some embodiments, anti-EPO antibodies, anti-EPOR antibodies, or functional fragments thereof can be antagonists for hetero-EPOR and can have a higher binding affinity to hetero-EPOR than to homo-EPOR. In some embodiments, anti-EPO antibodies, anti-EPOR antibodies, or functional fragments thereof described herein can be antagonists for hetero-EPOR and can have a hetero-EPOR binding affinity that is at least about 1%, at least about 2%, at least about 3%, at least about 4%, at least about 5%, at least about 6%, at least about 7%, at least about 8%, at least about 9%, at least about 10%, at least about 11%, at least about 12%, at least about 13%, at least about 14%, at least about 15%, at least about 16%, at least about 17%, at least about 18%, at least about 19%, at least about 20%, at least about 21%, at least about 22%, at least about 23%, at least about 24%, at least about 25%, at least about 26%, at least about 27%, at least about 28%, at least about 29%, at least about 30%, at least about 31%, at least about 32%, at least about 33%, at least about 34%, at least about 35%, at least about 36%, at least about 37%, at least about 38%, at least about 39%, at least about 40%, at least about 41%, at least about 42%, at least about 43%, at least about 44%, at least about 45%, at least about 46%, at least about 47%, at least about 48%, at least about 49%, at least about 50%, at least about 55%, at least about 60%, at least about 65%, at least about 70%, at least about 75%, at least about 80%, at least about 85%, at least about 90%, at least about 95%, or at least about 99% higher than a homo-EPOR binding affinity.

In some embodiments, anti-EPO antibodies, anti-EPOR antibodies, or functional fragments thereof can be antagonists for hetero-EPOR and can have binding specificity or selectivity for a hetero-EPOR. In some embodiments, anti-EPO antibodies, anti-EPOR antibodies, or functional fragments thereof can be antagonists for hetero-EPOR and can have a higher specificity or selectivity to hetero-EPOR than to homo-EPOR. For example, anti-EPO antibodies, anti-EPOR antibodies, or functional fragments thereof can be antagonists for hetero-EPOR and can have a hetero-EPOR binding specificity or selectivity that is higher than a homo- EPOR binding specificity or selectivity. In some embodiments, anti-EPO antibodies, anti-EPOR antibodies, or functional fragments thereof described herein can be antagonists for hetero-EPOR and have a hetero-EPOR binding specificity or selectivity that is at least about 1%, at least about 2%, at least about 3%, at least about 4%, at least about 5%, at least about 6%, at least about 7%, at least about 8%, at least about 9%, at least about 10%, at least about 11%, at least about 12%, at least about 13%, at least about 14%, at least about 15%, at least about 16%, at least about 17%, at least about 18%, at least about 19%, at least about 20%, at least about 21%, at least about 22%, at least about 23%, at least about 24%, at least about 25%, at least about 26%, at least about 27%, at least about 28%, at least about 29%, at least about 30%, at least about 31%, at least about 32%, at least about 33%, at least about 34%, at least about 35%, at least about 36%, at least about 37%, at least about 38%, at least about 39%, at least about 40%, at least about 41%, at least about 42%, at least about 43%, at least about 44%, at least about 45%, at least about 46%, at least about 47%, at least about 48%, at least about 49%, at least about 50%, at least about 55%, at least about 60%, at least about 65%, at least about 70%, at least about 75%, at least about 80%, at least about 85%, at least about 90%, at least about 95%, or at least about 99% higher than a homo-EPOR binding specificity or selectivity.

In some embodiments, anti-EPO antibodies, anti-EPOR antibodies, or functional fragments thereof described herein can bind to a target and can act as agonists for homo-EPOR. In some embodiments, anti-EPO antibodies, anti-EPOR antibodies, or functional fragments thereof described herein can be agonists for homo-EPOR and can selectively bind to homo-EPOR. In some embodiments, anti-EPO antibodies, anti-EPOR antibodies, or functional fragments thereof can be agonists for homo-EPOR and can have a higher binding affinity to homo-EPOR than to hetero-EPOR. In some embodiments, anti-EPO antibodies, anti-EPOR antibodies, or functional fragments thereof described herein can be agonists for homo-EPOR and can have a homo-EPOR binding affinity that is at least about 1%, at least about 2%, at least about 3%, at least about 4%, at least about 5%, at least about 6%, at least about 7%, at least about 8%, at least about 9%, at least about 10%, at least about 11%, at least about 12%, at least about 13%, at least about 14%, at least about 15%, at least about 16%, at least about 17%, at least about 18%, at least about 19%, at least about 20%, at least about 21%, at least about 22%, at least about 23%, at least about 24%, at least about 25%, at least about 26%, at least about 27%, at least about 28%, at least about 29%, at least about 30%, at least about 31%, at least about 32%, at least about 33%, at least about 34%, at least about 35%, at least about 36%, at least about 37%, at least about 38%, at least about 39%, at least about 40%, at least about 41%, at least about 42%, at least about 43%, at least about 44%, at least about 45%, at least about 46%, at least about 47%, at least about 48%, at least about 49%, at least about 50%, at least about 55%, at least about 60%, at least about 65%, at least about 70%, at least about 75%, at least about 80%, at least about 85%, at least about 90%, at least about 95%, or at least about 99% higher than a hetero-EPOR binding affinity.

In some embodiments, anti-EPO antibodies, anti-EPOR antibodies, or functional fragments thereof can be agonists for homo-EPOR and can have binding specificity or selectivity for homo-EPOR. In some embodiments, anti-EPO antibodies, anti-EPOR antibodies, or functional fragments thereof can be agonists for homo-EPOR and can have a higher specificity or selectivity to homo-EPOR than to hetero-EPOR. For example, anti-EPO antibodies, anti-EPOR antibodies, or functional fragments thereof can be agonists for homo-EPOR and can have a homo-EPOR binding specificity or selectivity that is higher than a hetero-EPOR binding specificity or selectivity. In some embodiments, anti-EPO antibodies, anti-EPOR antibodies, or functional fragments thereof described herein can be agonists for homo-EPOR and have a homo-EPOR binding specificity or selectivity that is at least about 1%, at least about 2%, at least about 3%, at least about 4%, at least about 5%, at least about 6%, at least about 7%, at least about 8%, at least about 9%, at least about 10%, at least about 11%, at least about 12%, at least about 13%, at least about 14%, at least about 15%, at least about 16%, at least about 17%, at least about 18%, at least about 19%, at least about 20%, at least about 21%, at least about 22%, at least about 23%, at least about 24%, at least about 25%, at least about 26%, at least about 27%, at least about 28%, at least about 29%, at least about 30%, at least about 31%, at least about 32%, at least about 33%, at least about 34%, at least about 35%, at least about 36%, at least about 37%, at least about 38%, at least about 39%, at least about 40%, at least about 41%, at least about 42%, at least about 43%, at least about 44%, at least about 45%, at least about 46%, at least about 47%, at least about 48%, at least about 49%, at least about 50%, at least about 55%, at least about 60%, at least about 65%, at least about 70%, at least about 75%, at least about 80%, at least about 85%, at least about 90%, at least about 95%, or at least about 99% higher than a hetero-EPOR binding specificity or selectivity.

In some embodiments, anti-EPO antibodies, anti-EPOR antibodies, or functional fragments thereof described herein can bind to a target and can act as antagonists for homo-EPOR. In some embodiments, anti-EPO antibodies, anti-EPOR antibodies, or functional fragments thereof described herein can be antagonists for homo-EPOR and can selectively bind to homo-EPOR. In some embodiments, anti-EPO antibodies, anti-EPOR antibodies, or functional fragments thereof can be antagonists for homo-EPOR and can have a higher binding affinity to homo-EPOR than to hetero-EPOR. In some embodiments, anti-EPO antibodies, anti-EPOR antibodies, or functional fragments thereof described herein can be antagonists for homo-EPOR and can have a homo-EPOR binding affinity that is at least about 1%, at least about 2%, at least about 3%, at least about 4%, at least about 5%, at least about 6%, at least about 7%, at least about 8%, at least about 9%, at least about 10%, at least about 11%, at least about 12%, at least about 13%, at least about 14%, at least about 15%, at least about 16%, at least about 17%, at least about 18%, at least about 19%, at least about 20%, at least about 21%, at least about 22%, at least about 23%, at least about 24%, at least about 25%, at least about 26%, at least about 27%, at least about 28%, at least about 29%, at least about 30%, at least about 31%, at least about 32%, at least about 33%, at least about 34%, at least about 35%, at least about 36%, at least about 37%, at least about 38%, at least about 39%, at least about 40%, at least about 41%, at least about 42%, at least about 43%, at least about 44%, at least about 45%, at least about 46%, at least about 47%, at least about 48%, at least about 49%, at least about 50%, at least about 55%, at least about 60%, at least about 65%, at least about 70%, at least about 75%, at least about 80%, at least about 85%, at least about 90%, at least about 95%, or at least about 99% higher than a hetero-EPOR binding affinity.

In some embodiments, anti-EPO antibodies, anti-EPOR antibodies, or functional fragments thereof can be antagonists for homo-EPOR and can have binding specificity or selectivity for homo-EPOR. In some embodiments, anti-EPO antibodies, anti-EPOR antibodies, or functional fragments thereof can be antagonists for homo-EPOR and can have a higher specificity or selectivity to homo-EPOR than to hetero-EPOR. For example, anti-EPO antibodies, anti-EPOR antibodies, or functional fragments thereof can be antagonists for homo-EPOR and can have a homo-EPOR binding specificity or selectivity that is higher than a hetero-EPOR binding specificity or selectivity. In some embodiments, anti-EPO antibodies, anti-EPOR antibodies, or functional fragments thereof described herein can be antagonists for homo-EPOR and have a homo-EPOR binding specificity or selectivity that is at least about 1%, at least about 2%, at least about 3%, at least about 4%, at least about 5%, at least about 6%, at least about 7%, at least about 8%, at least about 9%, at least about 10%, at least about 11%, at least about 12%, at least about 13%, at least about 14%, at least about 15%, at least about 16%, at least about 17%, at least about 18%, at least about 19%, at least about 20%, at least about 21%, at least about 22%, at least about 23%, at least about 24%, at least about 25%, at least about 26%, at least about 27%, at least about 28%, at least about 29%, at least about 30%, at least about 31%, at least about 32%, at least about 33%, at least about 34%, at least about 35%, at least about 36%, at least about 37%, at least about 38%, at least about 39%, at least about 40%, at least about 41%, at least about 42%, at least about 43%, at least about 44%, at least about 45%, at least about 46%, at least about 47%, at least about 48%, at least about 49%, at least about 50%, at least about 55%, at least about 60%, at least about 65%, at least about 70%, at least about 75%, at least about 80%, at least about 85%, at least about 90%, at least about 95%, or at least about 99% higher than a hetero-EPOR binding specificity or selectivity.

In some aspects, antibodies described herein have specificity for EPO, hetero-EPOR, or homo-EPOR and include all the forms described above. The antibody can be engineered for use in a particular organism. The organism can be a human, canine, or a commercially valuable livestock, such as, for example, pigs, horses, dogs, cats, chickens, or other birds. Such engineering of the antibody can include, for example, CDR splicing, humanization, humaneering, chimerization, or isolating human (or other organism) antibodies using any of the repertoire technologies or monoclonal technologies known in the art.

Certain examples of antibodies with alternative scaffolds can include, but are not limited to, nanobodies, affibodies, microbodies, evibodies, and domain antibodies. Certain examples of alternative scaffolds useful for creating antibodies can include, but are not limited to, single domain antibodies from camelids; protease inhibitors; human serum transferrin; CTLA-4; fibronectin, including, but not limited to, the fibronectin type III domain; C-type lectin-like domains; lipocalin family proteins; ankyrin repeat proteins; the Z-domain of Protein A; gamma-crystallin; Tendamistat; Neocarzinostatin; CBM4-2; the T-cell receptor; Im9; designed AR proteins; designed TPR proteins; zinc finger domains; pVIII; Avian Pancreatic Polypeptide; GCN4; WW domains; Src Homology 3 (SH3) domains; Src Homology 2 (SH2) domains; PDZ domains; TEM-1 beta-lactamase; GFP; Thioredoxin; Staphylcoccal nuclease; PHD-finger domains; CI-2; BPTI; APPI; HPSTI; Ecotin; LACI-D1; LDTI; MTI-II; scorpion toxins; Insect Defensin A Peptide; EETI-II; Min-23; CBD; PBP; Cytochrome $b_{562}$; Transferrin; LDL Receptor Domain A; and ubiquitin. Certain examples of alternative scaffolds are discussed in Hey et al., "Artificial, non-antibody binding proteins for pharmaceutical and industrial applications" Trends in Biotechnology, 23:514-22 (2005) and Binz et al., "Engineering novel binding proteins from nonimmunoglobulin domains" Nature Biotechnology, 23:1257-68 (2005), both of which are incorporated by reference in their entirety for all purposes.

A bispecific or bifunctional antibody can comprise two different heavy/light chain pairs and two different binding sites. Bispecific antibodies may be produced by a variety of methods including, but not limited to, fusion of hybridomas or linking of Fab' fragments. See, e.g., Songsivilai & Lachmann Clin. Exp. Immunol 79: 315-321 (1990), Kostelny et al. J. Immunol. 148:1547-1553 (1992), which is incorporated by reference in its entirety for all purposes.

Bispecific antibody molecules can be classified into five different structural groups: (i) bispecific immunoglobulin G (BsIgG); (ii) IgG appended with an additional antigen-binding moiety; (iii) bispecific antibody fragments; (iv) bispecific fusion proteins; and (v) bispecific antibody conjugates. BsIgG is a format that is monovalent for each antigen. Exemplary BsIgG formats include but are not limited to crossMab, DAF (two-in-one), DAF (four-in-one), DutaMab™, DT-IgG, knobs-in-holes common LC, knobs-in-holes assembly, charge pair, Fab-arm exchange, SEED-body, Triomab™, LUZ-Y, Fcab, Kk-body, orthogonal Fab. See Spiess et al. Mol. Immunol. 67(2015):95-106. Exemplary BsIgGs include catumaxomab (Fresenius Biotech, Trion Pharma, Neopharm), which contains an anti-CD3 arm and an anti-EpCAM arm; and ertumaxomab (Neovii Biotech, Fresenius Biotech), which targets CD3 and HER2. In some embodiments, BsIgG comprises heavy chains that are engineered for heterodimerization. For example, heavy chains can be engineered for heterodimerization using a "knobs-into-holes" strategy, a SEED platform, a common heavy chain (e.g., in KX-bodies), and use of heterodimeric Fc regions. See Spiess et al. Mol. Immunol. 67(2015):95-106. Strategies that have been used to avoid heavy chain pairing of homodimers in BsIgG include knobs-in-holes, DuoBody®, Azymetric™, charge pair, HA-TF, SEEDbody, and differential protein A affinity. See Id. BsIgG can be produced by separate expression of the component antibodies in different host cells and subsequent purification/assembly into a BsIgG. BsIgG can also be produced by expression of the component antibodies in a single host cell. BsIgG can be purified using affinity chromatography, e.g., using protein A and sequential pH elution. IgG appended with an additional antigen-binding moiety is another format of bispecific antibody molecules. For example, monospecific IgG can be engineered to have bispecificity by appending an additional antigen-binding unit onto the monospecific IgG, e.g., at the N- or C-terminus of either the heavy or light chain. Exemplary additional antigen-binding units include single domain antibodies (e.g., variable heavy chain or variable light chain), engineered protein scaffolds, and paired antibody variable domains (e.g., single chain variable fragments or variable fragments). See Id. Examples of appended IgG formats include dual variable domain IgG (DVD-Ig), IgG (H)-scFv, scFv-(H)IgG, IgG(L)-scFv, scFv-(L)IgG, IgG(L, H)-Fv, IgG(H)-V, V(H)-IgG, IgG(L)-V, V(L)-IgG, KIH IgG-scFab, 2scFv-IgG, IgG-2scFv, scFv4-Ig, zybody, and DVI-IgG (four-in-one). See Spiess et al. Mol. Immunol. 67(2015):95-106. An example of an IgG-scFv is MM-141 (Merrimack Pharmaceuticals), which binds IGF-1R and HER3. Examples of DVD-Ig include ABT-981 (AbbVie), which binds IL-1α and IL-1β; and ABT-122 (AbbVie), which binds TNF and IL-17A.

Bispecific antibody fragments (BsAb) are a format of bispecific antibody molecules that lack some or all of the antibody constant domains. For example, some BsAb lack an Fc region. In some embodiments, bispecific antibody fragments include heavy and light chain regions that are connected by a peptide linker that permits efficient expression of the BsAb in a single host cell. Exemplary bispecific antibody fragments include but are not limited to nanobody, nanobody-HAS, Bispecific T-cell engager (BiTE®), Diabody, Dual-Affinity Re-Targeting antibody (DART®), Tandem Diabody (TandAb), scDiabody, scDiabody-CH3, Diabody-CH3, triple body, miniantibody, minibody, Tandem Diabody (TriBi) minibody, scFv-CH3 KIH, Fab-scFv, scFv-CH-CL-scFv, F(ab')2, F(ab')2-scFv2, scFv-KIH, Fab-scFv-Fc, tetravalent HCAb, scDiabody-Fc, Diabody-Fc, tandem scFv-Fc, and intrabody. For example, the BiTE® format comprises tandem scFvs, where the component scFvs bind to CD3 on T cells and a surface antigen on cancer cells. Bispecific fusion proteins include antibody fragments linked to other proteins, e.g., to add additional specificity and/or functionality. An example of a bispecific fusion protein is an immTAC® (Immune mobilizing monoclonal TCRs Against Cancer), which comprises an anti-CD3 scFv linked to an affinity-matured T-cell receptor that recognizes HLA-presented peptides. In some embodiments, the dock-and-lock (DNL) method can be used to generate bispecific antibody molecules with higher valency. Also, fusions to albumin binding proteins or human serum albumin can be extend the serum half-life of antibody fragments. In some embodiments, chemical conjugation, e.g., chemical conjugation of antibodies and/or antibody fragments, can be used to create BsAb molecules. An exemplary bispecific antibody conjugate includes the CovX-Body™ format, in which a low molecular weight drug is conjugated site-specifically to a single reactive lysine in each Fab arm or an antibody or fragment thereof. In some embodiments, the conjugation improves the serum half-life of the low molecular weight drug. An exemplary CovX-Body™ is CVX-241 (NCT01004822), which comprises an antibody conjugated to two short peptides inhibiting either VEGF or Ang2. In some instances, bispecific antibodies can further comprise a linker. In some instances, bispecific antibodies can further comprise a Fc domain. The Fc domain can be, for example, a human IgG1 Fc domain. The Fc domain can comprise a knob-in-hole. In some instances, bispecific antibodies can further comprise a linker and an Fc domain. In some embodiments, a linker can be a peptide linker. Non-limiting examples of peptide linkers can include $(GS)_n$ (SEQ ID NO: 3880), $(GGS)_n$ (SEQ ID NO: 3881), $(GGGS)_n$ (SEQ ID NO: 3882), $(GGSG)_n$ (SEQ ID NO: 3883), $(GGSGG)_n$ (SEQ ID NO: 3884), or $(GGGGS)_n$ (SEQ ID NO: 3885), wherein n can be 1, 2, 3, 4, 5, 6, 7, 8, 9, or 10. For example, a linking peptide can be $(GGGGS)_3$ (SEQ ID NO: 3886) or $(GGGGS)_4$ (SEQ ID NO: 3887). Linkers described herein can be used for multispecific antibodies. In this embodiment, multispecific antibodies can have more than one linker. In this embodiment, the linker can be the same. Alternatively, the linkers can be different.

The antibody molecules can be produced by recombinant expression, e.g., of at least one or more component, in a host system. Exemplary host systems include eukaryotic cells (e.g., mammalian cells, e.g., CHO cells, or insect cells, e.g., SF9 or S2 cells) and prokaryotic cells (e.g., E. coli). Bispecific antibody molecules can be produced by separate expression of the components in different host cells and subsequent purification/assembly. Alternatively, the antibody molecules can be produced by expression of the components in a single host cell. Purification of bispecific antibody molecules can be performed by various methods such as affinity chromatography, e.g., using protein A and sequential pH elution. In other embodiments, affinity tags can be used for purification, e.g., histidine-containing tag, myc tag, or streptavidin tag.

In an aspect, an antibody may be part of a conjugate molecule comprising all or part of the antibody and a prodrug. The term "prodrug" refers to a precursor or derivative form of a pharmaceutically active substance. A prodrug can be less cytotoxic to cells compared to the parent drug and capable of being enzymatically activated or converted into the more active cytotoxic parent form. Exemplary prodrugs can include, but are not limited to, phosphate-containing prodrugs, thiophosphate-containing prodrugs, sulfate-containing prodrugs, peptide-containing prodrugs, D-amino acid-modified prodrugs, glycosylated prodrugs, beta-lactam-containing prodrugs, optionally substituted phe-noxyacetamide-containing prodrugs and optionally substi-tuted phenylacetamide-containing prodrugs, 5-fluorocyto-sine and other 5-fluorouridine prodrugs which can be converted into a more active cytotoxic free drug. Examples of cytotoxic drugs that can be derivatized into a prodrug form can include, but are not limited to, those cytotoxic agents described above. See, e.g., U.S. Pat. No. 6,702,705.

In some aspect, an anti-EPOR, anti-CD131, or anti-EPO antibody can comprise an antigen binding domain or an antigen binding fragment. In some embodiments, an antigen binding domain or an antigen binding fragment can com-prise a heavy chain variable region (VH), a light chain variable region (VL), or a combination thereof. In some embodiments, a heavy chain variable region (VH) can comprise a sequence with at least 100%, 99.9%, 99.8%, 99.7%, 99.6%, 99.5%, 99.4%, 99.3%, 99.2%, 99.1%, 99%, 98%, 97%, 96%, 95%, 94%, 93%, 92%, 91%, 90%, 85%, 80%, 75%, 70%, 65%, 60%, 55%, 50%, 45%, 40%, 35%, 30%, 25%, or at least 20% sequence identity to any one of VH sequences listed in Table 5. In some embodiments, a VH can comprise any one of VH sequences listed in Table 5. In some embodiments, a VH can comprise a sequence with at least 100%, 99.9%, 99.8%, 99.7%, 99.6%, 99.5%, 99.4%, 99.3%, 99.2%, 99.1%, 99%, 98%, 97%, 96%, 95%, 94%, 93%, 92%, 91%, 90%, 85%, 80%, 75%, 70%, 65%, 60%, 55%, 50%, 45%, 40%, 35%, 30%, 25%, or at least 20% sequence identity to any one of VH sequences listed in Table 7. In some embodiments, a VH can comprise any one of VH sequences listed in Table 7. In some embodiments, a VH can comprise a sequence with at least 100%, 99.9%, 99.8%, 99.7%, 99.6%, 99.5%, 99.4%, 99.3%, 99.2%, 99.1%, 99%, 98%, 97%, 96%, 95%, 94%, 93%, 92%, 91%, 90%, 85%, 80%, 75%, 70%, 65%, 60%, 55%, 50%, 45%, 40%, 35%, 30%, 25%, or at least 20% sequence identity to any one of VH sequences listed in Table 9. In some embodiments, a VH can comprise any one of VH sequences listed in Table 9.

In some embodiments, a light chain variable region (VL) can comprise a sequence with at least 100%, 99.9%, 99.8%, 99.7%, 99.6%, 99.5%, 99.4%, 99.3%, 99.2%, 99.1%, 99%, 98%, 97%, 96%, 95%, 94%, 93%, 92%, 91%, 90%, 85%, 80%, 75%, 70%, 65%, 60%, 55%, 50%, 45%, 40%, 35%, 30%, 25%, or at least 20% sequence identity to any one of VL sequences listed in Table 5. In some embodiments, a VL can comprise any one of VL sequences listed in Table 5. In some embodiments, a VL can comprise a sequence with at least 100%, 99.9%, 99.8%, 99.7%, 99.6%, 99.5%, 99.4%, 99.3%, 99.2%, 99.1%, 99%, 98%, 97%, 96%, 95%, 94%, 93%, 92%, 91%, 90%, 85%, 80%, 75%, 70%, 65%, 60%, 55%, 50%, 45%, 40%, 35%, 30%, 25%, or at least 20% sequence identity to any one of VL sequences listed in Table 7. In some embodiments, a VL can comprise any one of VL sequences listed in Table 7. In some embodiments, a VL can comprise a sequence with at least 100%, 99.9%, 99.8%, 99.7%, 99.6%, 99.5%, 99.4%, 99.3%, 99.2%, 99.1%, 99%, 98%, 97%, 96%, 95%, 94%, 93%, 92%, 91%, 90%, 85%, 80%, 75%, 70%, 65%, 60%, 55%, 50%, 45%, 40%, 35%, 30%, 25%, or at least 20% sequence identity to any one of VL sequences listed in Table 9. In some embodiments, a VL can comprise any one of VL sequences listed in Table 9.

In some embodiments, a VH can comprise a VH comple-mentarity determining region 1 (VH-CDR1), a VH-CDR2, or a VH-CDR3. In some embodiments, a VH can comprise a VH complementarity determining region 1 (VH-CDR1), a VH-CDR2, and a VH-CDR3.

In some embodiments, a VH-CDR1 can comprise a sequence with at least 100%, 99.9%, 99.8%, 99.7%, 99.6%, 99.5%, 99.4%, 99.3%, 99.2%, 99.1%, 99%, 98%, 97%, 96%, 95%, 94%, 93%, 92%, 91%, 90%, 85%, 80%, 75%, 70%, 65%, 60%, 55%, 50%, 45%, 40%, 35%, 30%, 25%, or at least 20% sequence identity to any one of VH-CDR1 sequences listed in Table 14. In some embodiments, a VH-CDR1 can comprise a sequence with at least 100%, 99.9%, 99.8%, 99.7%, 99.6%, 99.5%, 99.4%, 99.3%, 99.2%, 99.1%, 99%, 98%, 97%, 96%, 95%, 94%, 93%, 92%, 91%, 90%, 85%, 80%, 75%, 70%, 65%, 60%, 55%, 50%, 45%, 40%, 35%, 30%, 25%, or at least 20% sequence identity to any one of SEQ ID NOs: 2068-2255. In some embodiments, a VH-CDR1 can comprise a sequence of any one of SEQ ID NOs: 2068-2255. In some embodiments, an anti-EPOR antibody that binds to EPO receptor subunit can comprise a VH-CDR1 sequence with at least 100%, 99.9%, 99.8%, 99.7%, 99.6%, 99.5%, 99.4%, 99.3%, 99.2%, 99.1%, 99%, 98%, 97%, 96%, 95%, 94%, 93%, 92%, 91%, 90%, 85%, 80%, 75%, 70%, 65%, 60%, 55%, 50%, 45%, 40%, 35%, 30%, 25%, or at least 20% sequence identity to any one of VH-CDR1 sequences listed in Table 14.

In some embodiments, a VH-CDR1 can comprise a sequence with at least 100%, 99.9%, 99.8%, 99.7%, 99.6%, 99.5%, 99.4%, 99.3%, 99.2%, 99.1%, 99%, 98%, 97%, 96%, 95%, 94%, 93%, 92%, 91%, 90%, 85%, 80%, 75%, 70%, 65%, 60%, 55%, 50%, 45%, 40%, 35%, 30%, 25%, or at least 20% sequence identity to any one of VH-CDR1 sequences listed in Table 15. In some embodiments, a VH-CDR1 can comprise a sequence with at least 100%, 99.9%, 99.8%, 99.7%, 99.6%, 99.5%, 99.4%, 99.3%, 99.2%, 99.1%, 99%, 98%, 97%, 96%, 95%, 94%, 93%, 92%, 91%, 90%, 85%, 80%, 75%, 70%, 65%, 60%, 55%, 50%, 45%, 40%, 35%, 30%, 25%, or at least 20% sequence identity to any one of SEQ ID NOs: 2820-2948. In some embodiments, a VH-CDR1 can comprise a sequence of any one of SEQ ID NOs: 2820-2948. In some embodiments, an anti-CD131 antibody that binds to EPO receptor subunit can comprise a VH-CDR1 sequence with at least 100%, 99.9%, 99.8%, 99.7%, 99.6%, 99.5%, 99.4%, 99.3%, 99.2%, 99.1%, 99%, 98%, 97%, 96%, 95%, 94%, 93%, 92%, 91%, 90%, 85%, 80%, 75%, 70%, 65%, 60%, 55%, 50%, 45%, 40%, 35%, 30%, 25%, or at least 20% sequence identity to any one of VH-CDR1 sequences listed in Table 15.

In some embodiments, a VH-CDR1 can comprise a sequence with at least 100%, 99.9%, 99.8%, 99.7%, 99.6%, 99.5%, 99.4%, 99.3%, 99.2%, 99.1%, 99%, 98%, 97%, 96%, 95%, 94%, 93%, 92%, 91%, 90%, 85%, 80%, 75%, 70%, 65%, 60%, 55%, 50%, 45%, 40%, 35%, 30%, 25%, or at least 20% sequence identity to any one of VH-CDR1 sequences listed in Table 16. In some embodiments, a VH-CDR1 can comprise a sequence with at least 100%, 99.9%, 99.8%, 99.7%, 99.6%, 99.5%, 99.4%, 99.3%, 99.2%, 99.1%, 99%, 98%, 97%, 96%, 95%, 94%, 93%, 92%, 91%, 90%, 85%, 80%, 75%, 70%, 65%, 60%, 55%, 50%, 45%, 40%, 35%, 30%, 25%, or at least 20% sequence identity to any one of SEQ ID NOs: 3336-3471. In some embodiments, a VH-CDR1 can comprise a sequence of any one of SEQ ID NOs: 3336-3471. In some embodiments, an anti-EPOR antibody that binds to both EPO receptor subunit and CD131 subunit of a hetero-EPOR can comprise a VH-CDR1 sequence with at least 100%, 99.9%, 99.8%, 99.7%, 99.6%, 99.5%, 99.4%, 99.3%, 99.2%, 99.1%, 99%, 98%, 97%, 96%, 95%, 94%, 93%, 92%, 91%, 90%, 85%, 80%, 75%, 70%, 65%, 60%, 55%, 50%, 45%, 40%, 35%, 30%, 25%, or at least 20% sequence identity to any one of VH-CDR1 sequences listed in Table 16.

In some embodiments, a VH-CDR2 can comprise a sequence with at least 100%, 99.9%, 99.8%, 99.7%, 99.6%, 99.5%, 99.4%, 99.3%, 99.2%, 99.1%, 99%, 98%, 97%, 96%, 95%, 94%, 93%, 92%, 91%, 90%, 85%, 80%, 75%, 70%, 65%, 60%, 55%, 50%, 45%, 40%, 35%, 30%, 25%, or at least 20% sequence identity to any one of VH-CDR2 sequences in Table 14. In some embodiments, a VH-CDR2 can comprise a sequence with at least 100%, 99.9%, 99.8%, 99.7%, 99.6%, 99.5%, 99.4%, 99.3%, 99.2%, 99.1%, 99%, 98%, 97%, 96%, 95%, 94%, 93%, 92%, 91%, 90%, 85%, 80%, 75%, 70%, 65%, 60%, 55%, 50%, 45%, 40%, 35%, 30%, 25%, or at least 20% sequence identity to any one of SEQ ID NOs: 2256-2443. In some embodiments, a VH-CDR2 can comprise a sequence of any one of SEQ ID NOs: 2256-2443. In some embodiments, an anti-EPOR antibody that binds to EPO receptor subunit can comprise a VH-CDR2 sequence with at least 100%, 99.9%, 99.8%, 99.7%, 99.6%, 99.5%, 99.4%, 99.3%, 99.2%, 99.1%, 99%, 98%, 97%, 96%, 95%, 94%, 93%, 92%, 91%, 90%, 85%, 80%, 75%, 70%, 65%, 60%, 55%, 50%, 45%, 40%, 35%, 30%, 25%, or at least 20% sequence identity to any one of VH-CDR2 sequences listed in Table 14.

In some embodiments, a VH-CDR2 can comprise a sequence with at least 100%, 99.9%, 99.8%, 99.7%, 99.6%, 99.5%, 99.4%, 99.3%, 99.2%, 99.1%, 99%, 98%, 97%, 96%, 95%, 94%, 93%, 92%, 91%, 90%, 85%, 80%, 75%, 70%, 65%, 60%, 55%, 50%, 45%, 40%, 35%, 30%, 25%, or at least 20% sequence identity to any one of VH-CDR2 sequences listed in Table 15. In some embodiments, a VH-CDR2 can comprise a sequence with at least 100%, 99.9%, 99.8%, 99.7%, 99.6%, 99.5%, 99.4%, 99.3%, 99.2%, 99.1%, 99%, 98%, 97%, 96%, 95%, 94%, 93%, 92%, 91%, 90%, 85%, 80%, 75%, 70%, 65%, 60%, 55%, 50%, 45%, 40%, 35%, 30%, 25%, or at least 20% sequence identity to any one of SEQ ID NOs: 2949-3077. In some embodiments, a VH-CDR2 can comprise a sequence of any one of SEQ ID NOs: 2949-3077. In some embodiments, an anti-CD131 antibody that binds to EPO receptor subunit can comprise a VH-CDR2 sequence with at least 100%, 99.9%, 99.8%, 99.7%, 99.6%, 99.5%, 99.4%, 99.3%, 99.2%, 99.1%, 99%, 98%, 97%, 96%, 95%, 94%, 93%, 92%, 91%, 90%, 85%, 80%, 75%, 70%, 65%, 60%, 55%, 50%, 45%, 40%, 35%, 30%, 25%, or at least 20% sequence identity to any one of VH-CDR2 sequences listed in Table 15.

In some embodiments, a VH-CDR2 can comprise a sequence with at least 100%, 99.9%, 99.8%, 99.7%, 99.6%, 99.5%, 99.4%, 99.3%, 99.2%, 99.1%, 99%, 98%, 97%, 96%, 95%, 94%, 93%, 92%, 91%, 90%, 85%, 80%, 75%, 70%, 65%, 60%, 55%, 50%, 45%, 40%, 35%, 30%, 25%, or at least 20% sequence identity to any one of VH-CDR2 sequences listed in Table 16. In some embodiments, a VH-CDR2 can comprise a sequence with at least 100%, 99.9%, 99.8%, 99.7%, 99.6%, 99.5%, 99.4%, 99.3%, 99.2%, 99.1%, 99%, 98%, 97%, 96%, 95%, 94%, 93%, 92%, 91%, 90%, 85%, 80%, 75%, 70%, 65%, 60%, 55%, 50%, 45%, 40%, 35%, 30%, 25%, or at least 20% sequence identity to any one of SEQ ID NOs: 3472-3607. In some embodiments, a VH-CDR2 can comprise a sequence of any one of SEQ ID NOs: 3472-3607. In some embodiments, an anti-EPOR antibody that binds to both EPO receptor subunit and CD131 subunit of a hetero-EPOR can comprise a VH-CDR2 sequence with at least 100%, 99.9%, 99.8%, 99.7%, 99.6%, 99.5%, 99.4%, 99.3%, 99.2%, 99.1%, 99%, 98%, 97%, 96%, 95%, 94%, 93%, 92%, 91%, 90%, 85%, 80%, 75%, 70%, 65%, 60%, 55%, 50%, 45%, 40%, 35%, 30%, 25%, or at least 20% sequence identity to any one of VH-CDR2 sequences listed in Table 16.

In some embodiments, a VH-CDR3 can comprise a sequence with at least 100%, 99.9%, 99.8%, 99.7%, 99.6%, 99.5%, 99.4%, 99.3%, 99.2%, 99.1%, 99%, 98%, 97%, 96%, 95%, 94%, 93%, 92%, 91%, 90%, 85%, 80%, 75%, 70%, 65%, 60%, 55%, 50%, 45%, 40%, 35%, 30%, 25%, or at least 20% sequence identity to any one of VH-CDR3 sequences listed in Table 4. In some embodiments, a VH-CDR3 can comprise a sequence with at least 100%, 99.9%, 99.8%, 99.7%, 99.6%, 99.5%, 99.4%, 99.3%, 99.2%, 99.1%, 99%, 98%, 97%, 96%, 95%, 94%, 93%, 92%, 91%, 90%, 85%, 80%, 75%, 70%, 65%, 60%, 55%, 50%, 45%, 40%, 35%, 30%, 25%, or at least 20% sequence identity to any one of SEQ ID NOs: 63-250. In some embodiments, a VH-CDR3 can comprise a sequence of any one of SEQ ID NOs: 63-250. In some embodiments, an anti-EPOR antibody that binds to EPO receptor subunit can comprise a VH-CDR3 sequence with at least 100%, 99.9%, 99.8%, 99.7%, 99.6%, 99.5%, 99.4%, 99.3%, 99.2%, 99.1%, 99%, 98%, 97%, 96%, 95%, 94%, 93%, 92%, 91%, 90%, 85%, 80%, 75%, 70%, 65%, 60%, 55%, 50%, 45%, 40%, 35%, 30%, 25%, or at least 20% sequence identity to any one of VH-CDR3 sequences listed in Table 4.

In some embodiments, a VH-CDR3 can comprise a sequence with at least 100%, 99.9%, 99.8%, 99.7%, 99.6%, 99.5%, 99.4%, 99.3%, 99.2%, 99.1%, 99%, 98%, 97%, 96%, 95%, 94%, 93%, 92%, 91%, 90%, 85%, 80%, 75%, 70%, 65%, 60%, 55%, 50%, 45%, 40%, 35%, 30%, 25%, or at least 20% sequence identity to any one of VH-CDR3 sequences listed in Table 6. In some embodiments, a VH-CDR3 can comprise a sequence with at least 100%, 99.9%, 99.8%, 99.7%, 99.6%, 99.5%, 99.4%, 99.3%, 99.2%, 99.1%, 99%, 98%, 97%, 96%, 95%, 94%, 93%, 92%, 91%, 90%, 85%, 80%, 75%, 70%, 65%, 60%, 55%, 50%, 45%, 40%, 35%, 30%, 25%, or at least 20% sequence identity to any one of SEQ ID NOs: 815-943. In some embodiments, a VH-CDR3 can comprise a sequence of any one of SEQ ID NOs: 815-943. In some embodiments, an anti-CD131 antibody that binds to CD131 subunit of a hetero-EPOR can comprise a VH-CDR3 sequence with at least 100%, 99.9%, 99.8%, 99.7%, 99.6%, 99.5%, 99.4%, 99.3%, 99.2%, 99.1%, 99%, 98%, 97%, 96%, 95%, 94%, 93%, 92%, 91%, 90%, 85%, 80%, 75%, 70%, 65%, 60%, 55%, 50%, 45%, 40%, 35%, 30%, 25%, or at least 20% sequence identity to any one of VH-CDR3 sequences listed in Table 6.

In some embodiments, a VH-CDR3 can comprise a sequence with at least 100%, 99.9%, 99.8%, 99.7%, 99.6%, 99.5%, 99.4%, 99.3%, 99.2%, 99.1%, 99%, 98%, 97%, 96%, 95%, 94%, 93%, 92%, 91%, 90%, 85%, 80%, 75%, 70%, 65%, 60%, 55%, 50%, 45%, 40%, 35%, 30%, 25%, or at least 20% sequence identity to any one of VH-CDR3 sequences listed in Table 8. In some embodiments, a VH-CDR3 can comprise a sequence with at least 100%, 99.9%, 99.8%, 99.7%, 99.6%, 99.5%, 99.4%, 99.3%, 99.2%, 99.1%, 99%, 98%, 97%, 96%, 95%, 94%, 93%, 92%, 91%, 90%, 85%, 80%, 75%, 70%, 65%, 60%, 55%, 50%, 45%, 40%, 35%, 30%, 25%, or at least 20% sequence identity to any one of SEQ ID NOs: 1331-1466. In some embodiments, a VH-CDR3 can comprise a sequence of any one of SEQ ID NOs: 1331-1466. In some embodiments, an anti-EPOR antibody that binds to both EPO receptor subunit and CD131 subunit of a hetero-EPOR can comprise a VH-CDR3 sequence with at least 100%, 99.9%, 99.8%, 99.7%, 99.6%, 99.5%, 99.4%, 99.3%, 99.2%, 99.1%, 99%, 98%, 97%, 96%, 95%, 94%, 93%, 92%, 91%, 90%, 85%, 80%, 75%, 70%, 65%, 60%, 55%, 50%, 45%, 40%, 35%, 30%, 25%, or at least 20% sequence identity to any one of VH-CDR3 sequences listed in Table 8.

In some embodiments, a VL can comprise a VL complementarity determining region 1 (VL-CDR1), a VL-CDR2, or a VL-CDR3. In some embodiments, a VL can comprise a VL complementarity determining region 1 (VL-CDR1), a VL-CDR2, and a VL-CDR3.

In some embodiments, a VL-CDR1 can comprise a sequence with at least 100%, 99.9%, 99.8%, 99.7%, 99.6%, 99.5%, 99.4%, 99.3%, 99.2%, 99.1%, 99%, 98%, 97%, 96%, 95%, 94%, 93%, 92%, 91%, 90%, 85%, 80%, 75%, 70%, 65%, 60%, 55%, 50%, 45%, 40%, 35%, 30%, 25%, or at least 20% sequence identity to any one of VL-CDR1 sequences listed in Table 14. In some embodiments, a VL-CDR1 can comprise a sequence with at least 100%, 99.9%, 99.8%, 99.7%, 99.6%, 99.5%, 99.4%, 99.3%, 99.2%, 99.1%, 99%, 98%, 97%, 96%, 95%, 94%, 93%, 92%, 91%, 90%, 85%, 80%, 75%, 70%, 65%, 60%, 55%, 50%, 45%, 40%, 35%, 30%, 25%, or at least 20% sequence identity to any one of SEQ ID NOs: 2444-2631. In some embodiments, a VL-CDR1 can comprise a sequence of any one of SEQ ID NOs: 2444-2631. In some embodiments, an anti-EPOR antibody that binds to EPO receptor subunit can comprise a VL-CDR1 sequence with at least 100%, 99.9%, 99.8%, 99.7%, 99.6%, 99.5%, 99.4%, 99.3%, 99.2%, 99.1%, 99%, 98%, 97%, 96%, 95%, 94%, 93%, 92%, 91%, 90%, 85%, 80%, 75%, 70%, 65%, 60%, 55%, 50%, 45%, 40%, 35%, 30%, 25%, or at least 20% sequence identity to any one of VL-CDR1 sequences listed in Table 14.

In some embodiments, a VL-CDR1 can comprise a sequence with at least 100%, 99.9%, 99.8%, 99.7%, 99.6%, 99.5%, 99.4%, 99.3%, 99.2%, 99.1%, 99%, 98%, 97%, 96%, 95%, 94%, 93%, 92%, 91%, 90%, 85%, 80%, 75%, 70%, 65%, 60%, 55%, 50%, 45%, 40%, 35%, 30%, 25%, or at least 20% sequence identity to any one of VL-CDR1 sequences listed in Table 15. In some embodiments, a VL-CDR1 can comprise a sequence with at least 100%, 99.9%, 99.8%, 99.7%, 99.6%, 99.5%, 99.4%, 99.3%, 99.2%, 99.1%, 99%, 98%, 97%, 96%, 95%, 94%, 93%, 92%, 91%, 90%, 85%, 80%, 75%, 70%, 65%, 60%, 55%, 50%, 45%, 40%, 35%, 30%, 25%, or at least 20% sequence identity to any one of SEQ ID NOs: 3078-3206. In some embodiments, a VL-CDR1 can comprise a sequence of any one of SEQ ID NOs: 3078-3206. In some embodiments, an anti-CD131 antibody that binds to EPO receptor subunit can comprise a VL-CDR1 sequence with at least 100%, 99.9%, 99.8%, 99.7%, 99.6%, 99.5%, 99.4%, 99.3%, 99.2%, 99.1%, 99%, 98%, 97%, 96%, 95%, 94%, 93%, 92%, 91%, 90%, 85%, 80%, 75%, 70%, 65%, 60%, 55%, 50%, 45%, 40%, 35%, 30%, 25%, or at least 20% sequence identity to any one of VL-CDR1 sequences listed in Table 15.

In some embodiments, a VL-CDR1 can comprise a sequence with at least 100%, 99.9%, 99.8%, 99.7%, 99.6%, 99.5%, 99.4%, 99.3%, 99.2%, 99.1%, 99%, 98%, 97%, 96%, 95%, 94%, 93%, 92%, 91%, 90%, 85%, 80%, 75%, 70%, 65%, 60%, 55%, 50%, 45%, 40%, 35%, 30%, 25%, or at least 20% sequence identity to any one of VL-CDR1 sequences listed in Table 16. In some embodiments, a VL-CDR1 can comprise a sequence with at least 100%, 99.9%, 99.8%, 99.7%, 99.6%, 99.5%, 99.4%, 99.3%, 99.2%, 99.1%, 99%, 98%, 97%, 96%, 95%, 94%, 93%, 92%, 91%, 90%, 85%, 80%, 75%, 70%, 65%, 60%, 55%, 50%, 45%, 40%, 35%, 30%, 25%, or at least 20% sequence identity to any one of SEQ ID NOs: 3608-3743. In some embodiments, a VL-CDR1 can comprise a sequence of any one of SEQ ID NOs: 3608-3743. In some embodiments, an anti-EPOR antibody that binds to both EPO receptor subunit and CD131 subunit of a hetero-EPOR can comprise a VL-CDR1 sequence with at least 100%, 99.9%, 99.8%, 99.7%, 99.6%, 99.5%, 99.4%, 99.3%, 99.2%, 99.1%, 99%, 98%, 97%, 96%, 95%, 94%, 93%, 92%, 91%, 90%, 85%, 80%, 75%, 70%, 65%, 60%, 55%, 50%, 45%, 40%, 35%, 30%, 25%, or at least 20% sequence identity to any one of VL-CDR1 sequences listed in Table 16.

In some embodiments, a VL-CDR2 can comprise a sequence with at least 100%, 99.9%, 99.8%, 99.7%, 99.6%, 99.5%, 99.4%, 99.3%, 99.2%, 99.1%, 99%, 98%, 97%, 96%, 95%, 94%, 93%, 92%, 91%, 90%, 85%, 80%, 75%, 70%, 65%, 60%, 55%, 50%, 45%, 40%, 35%, 30%, 25%, or at least 20% sequence identity to any one of VL-CDR2 sequences in Table 14. In some embodiments, a VL-CDR2 can comprise a sequence with at least 100%, 99.9%, 99.8%, 99.7%, 99.6%, 99.5%, 99.4%, 99.3%, 99.2%, 99.1%, 99%, 98%, 97%, 96%, 95%, 94%, 93%, 92%, 91%, 90%, 85%, 80%, 75%, 70%, 65%, 60%, 55%, 50%, 45%, 40%, 35%, 30%, 25%, or at least 20% sequence identity to any one of SEQ ID NOs: 2632-2819. In some embodiments, a VL-CDR2 can comprise a sequence of any one of SEQ ID NOs: 2632-2819. In some embodiments, an anti-EPOR antibody that binds to EPO receptor subunit can comprise a VL-CDR2 sequence with at least 100%, 99.9%, 99.8%, 99.7%, 99.6%, 99.5%, 99.4%, 99.3%, 99.2%, 99.1%, 99%, 98%, 97%, 96%, 95%, 94%, 93%, 92%, 91%, 90%, 85%, 80%, 75%, 70%, 65%, 60%, 55%, 50%, 45%, 40%, 35%, 30%, 25%, or at least 20% sequence identity to any one of VL-CDR2 sequences listed in Table 14.

In some embodiments, a VL-CDR2 can comprise a sequence with at least 100%, 99.9%, 99.8%, 99.7%, 99.6%, 99.5%, 99.4%, 99.3%, 99.2%, 99.1%, 99%, 98%, 97%, 96%, 95%, 94%, 93%, 92%, 91%, 90%, 85%, 80%, 75%, 70%, 65%, 60%, 55%, 50%, 45%, 40%, 35%, 30%, 25%, or at least 20% sequence identity to any one of VL-CDR2 sequences listed in Table 15. In some embodiments, a VL-CDR2 can comprise a sequence with at least 100%, 99.9%, 99.8%, 99.7%, 99.6%, 99.5%, 99.4%, 99.3%, 99.2%, 99.1%, 99%, 98%, 97%, 96%, 95%, 94%, 93%, 92%, 91%, 90%, 85%, 80%, 75%, 70%, 65%, 60%, 55%, 50%, 45%, 40%, 35%, 30%, 25%, or at least 20% sequence identity to any one of SEQ ID NOs: 3207-3335. In some embodiments, a VL-CDR2 can comprise a sequence of any one of SEQ ID NOs: 3207-3335. In some embodiments, an anti-CD131 antibody that binds to EPO receptor subunit can comprise a VL-CDR2 sequence with at least 100%, 99.9%, 99.8%, 99.7%, 99.6%, 99.5%, 99.4%, 99.3%, 99.2%, 99.1%, 99%, 98%, 97%, 96%, 95%, 94%, 93%, 92%, 91%, 90%, 85%, 80%, 75%, 70%, 65%, 60%, 55%, 50%, 45%, 40%, 35%, 30%, 25%, or at least 20% sequence identity to any one of VL-CDR2 sequences listed in Table 15.

In some embodiments, a VL-CDR2 can comprise a sequence with at least 100%, 99.9%, 99.8%, 99.7%, 99.6%, 99.5%, 99.4%, 99.3%, 99.2%, 99.1%, 99%, 98%, 97%, 96%, 95%, 94%, 93%, 92%, 91%, 90%, 85%, 80%, 75%, 70%, 65%, 60%, 55%, 50%, 45%, 40%, 35%, 30%, 25%, or at least 20% sequence identity to any one of VL-CDR2 sequences listed in Table 16. In some embodiments, a VL-CDR2 can comprise a sequence with at least 100%, 99.9%, 99.8%, 99.7%, 99.6%, 99.5%, 99.4%, 99.3%, 99.2%, 99.1%, 99%, 98%, 97%, 96%, 95%, 94%, 93%, 92%, 91%, 90%, 85%, 80%, 75%, 70%, 65%, 60%, 55%, 50%, 45%, 40%, 35%, 30%, 25%, or at least 20% sequence identity to any one of SEQ ID NOs: 3744-3879. In some embodiments, a VL-CDR2 can comprise a sequence of any one of SEQ ID NOs: 3744-3879. In some embodiments, an anti-EPOR antibody that binds to both EPO receptor subunit and CD131 subunit of a hetero-EPOR can comprise a VL-CDR2 sequence with at least 100%, 99.9%, 99.8%, 99.7%, 99.6%, 99.5%, 99.4%, 99.3%, 99.2%, 99.1%, 99%, 98%, 97%, 96%, 95%, 94%, 93%, 92%, 91%, 90%, 85%, 80%, 75%, 70%, 65%, 60%, 55%, 50%, 45%, 40%, 35%, 30%, 25%, or at least 20% sequence identity to any one of VL-CDR2 sequences listed in Table 16.

In some embodiments, a VL-CDR3 can comprise a sequence with at least 100%, 99.9%, 99.8%, 99.7%, 99.6%, 99.5%, 99.4%, 99.3%, 99.2%, 99.1%, 99%, 98%, 97%, 96%, 95%, 94%, 93%, 92%, 91%, 90%, 85%, 80%, 75%, 70%, 65%, 60%, 55%, 50%, 45%, 40%, 35%, 30%, 25%, or at least 20% sequence identity to any one of VH-CDR3 sequences listed in Table 4. In some embodiments, a VL-CDR3 can comprise a sequence with at least 100%, 99.9%, 99.8%, 99.7%, 99.6%, 99.5%, 99.4%, 99.3%, 99.2%, 99.1%, 99%, 98%, 97%, 96%, 95%, 94%, 93%, 92%, 91%, 90%, 85%, 80%, 75%, 70%, 65%, 60%, 55%, 50%, 45%, 40%, 35%, 30%, 25%, or at least 20% sequence identity to any one of SEQ ID NOs: 251-438. In some embodiments, a VL-CDR3 can comprise a sequence of any one of SEQ ID NOs: 251-438. In some embodiments, an anti-EPOR antibody that binds to EPO receptor subunit can comprise a VL-CDR3 sequence with at least 100%, 99.9%, 99.8%, 99.7%, 99.6%, 99.5%, 99.4%, 99.3%, 99.2%, 99.1%, 99%, 98%, 97%, 96%, 95%, 94%, 93%, 92%, 91%, 90%, 85%, 80%, 75%, 70%, 65%, 60%, 55%, 50%, 45%, 40%, 35%, 30%, 25%, or at least 20% sequence identity to any one of VL-CDR3 sequences listed in Table 4.

In some embodiments, a VL-CDR3 can comprise a sequence with at least 100%, 99.9%, 99.8%, 99.7%, 99.6%, 99.5%, 99.4%, 99.3%, 99.2%, 99.1%, 99%, 98%, 97%, 96%, 95%, 94%, 93%, 92%, 91%, 90%, 85%, 80%, 75%, 70%, 65%, 60%, 55%, 50%, 45%, 40%, 35%, 30%, 25%, or at least 20% sequence identity to any one of VL-CDR3 sequences listed in Table 6. In some embodiments, a VL-CDR3 can comprise a sequence with at least 100%, 99.9%, 99.8%, 99.7%, 99.6%, 99.5%, 99.4%, 99.3%, 99.2%, 99.1%, 99%, 98%, 97%, 96%, 95%, 94%, 93%, 92%, 91%, 90%, 85%, 80%, 75%, 70%, 65%, 60%, 55%, 50%, 45%, 40%, 35%, 30%, 25%, or at least 20% sequence identity to any one of SEQ ID NOs: 944-1072. In some embodiments, a VL-CDR3 can comprise a sequence of any one of SEQ ID NOs: 944-1072. In some embodiments, an anti-CD131 antibody that binds to CD131 subunit of a hetero-EPOR can comprise a VL-CDR3 sequence with at least 100%, 99.9%, 99.8%, 99.7%, 99.6%, 99.5%, 99.4%, 99.3%, 99.2%, 99.1%, 99%, 98%, 97%, 96%, 95%, 94%, 93%, 92%, 91%, 90%, 85%, 80%, 75%, 70%, 65%, 60%, 55%, 50%, 45%, 40%, 35%, 30%, 25%, or at least 20% sequence identity to any one of VL-CDR3 sequences listed in Table 6.

In some embodiments, a VL-CDR3 can comprise a sequence with at least 100%, 99.9%, 99.8%, 99.7%, 99.6%, 99.5%, 99.4%, 99.3%, 99.2%, 99.1%, 99%, 98%, 97%, 96%, 95%, 94%, 93%, 92%, 91%, 90%, 85%, 80%, 75%, 70%, 65%, 60%, 55%, 50%, 45%, 40%, 35%, 30%, 25%, or at least 20% sequence identity to any one of VL-CDR3 sequences listed in Table 8. In some embodiments, a VL-CDR3 can comprise a sequence with at least 100%, 99.9%, 99.8%, 99.7%, 99.6%, 99.5%, 99.4%, 99.3%, 99.2%, 99.1%, 99%, 98%, 97%, 96%, 95%, 94%, 93%, 92%, 91%, 90%, 85%, 80%, 75%, 70%, 65%, 60%, 55%, 50%, 45%, 40%, 35%, 30%, 25%, or at least 20% sequence identity to any one of SEQ ID NOs: 1467-1602. In some embodiments, a VL-CDR3 can comprise a sequence of any one of SEQ ID NOs: 1467-1602. In some embodiments, an anti-EPOR antibody that binds to both EPO receptor subunit and CD131 subunit of a hetero-EPOR can comprise a VL-CDR3 sequence with at least 100%, 99.9%, 99.8%, 99.7%, 99.6%, 99.5%, 99.4%, 99.3%, 99.2%, 99.1%, 99%, 98%, 97%, 96%, 95%, 94%, 93%, 92%, 91%, 90%, 85%, 80%, 75%, 70%, 65%, 60%, 55%, 50%, 45%, 40%, 35%, 30%, 25%, or at least 20% sequence identity to any one of VL-CDR3 sequences listed in Table 8.

In some embodiments, an anti-EPOR antibody that binds to EPO receptor subunit of a hetero-EPOR can comprise a VH-CDR1 comprising a sequence with at least 100%, 99.9%, 99.8%, 99.7%, 99.6%, 99.5%, 99.4%, 99.3%, 99.2%, 99.1%, 99%, 98%, 97%, 96%, 95%, 94%, 93%, 92%, 91%, 90%, 85%, 80%, 75%, 70%, 65%, 60%, 55%, 50%, 45%, 40%, 35%, 30%, 25%, or at least 20% sequence identity to any one of SEQ ID NOs: 2068-2255, a VH-CDR2 comprising a sequence with at least 100%, 99.9%, 99.8%, 99.7%, 99.6%, 99.5%, 99.4%, 99.3%, 99.2%, 99.1%, 99%, 98%, 97%, 96%, 95%, 94%, 93%, 92%, 91%, 90%, 85%, 80%, 75%, 70%, 65%, 60%, 55%, 50%, 45%, 40%, 35%, 30%, 25%, or at least 20% sequence identity to any one of SEQ ID NOs: 2256-2443, and a VH-CDR3 comprising a sequence with at least 100%, 99.9%, 99.8%, 99.7%, 99.6%, 99.5%, 99.4%, 99.3%, 99.2%, 99.1%, 99%, 98%, 97%, 96%, 95%, 94%, 93%, 92%, 91%, 90%, 85%, 80%, 75%, 70%, 65%, 60%, 55%, 50%, 45%, 40%, 35%, 30%, 25%, or at least 20% sequence identity to any one of SEQ ID NOs: 63-250. In some embodiments, an anti-EPOR antibody that binds to EPO receptor subunit of a hetero-EPOR can comprise a VL-CDR1 comprising a sequence with at least 100%, 99.9%, 99.8%, 99.7%, 99.6%, 99.5%, 99.4%, 99.3%, 99.2%, 99.1%, 99%, 98%, 97%, 96%, 95%, 94%, 93%, 92%, 91%, 90%, 85%, 80%, 75%, 70%, 65%, 60%, 55%, 50%, 45%, 40%, 35%, 30%, 25%, or at least 20% sequence identity to any one of SEQ ID NOs: 2444-2631, a VL-CDR2 comprising a sequence with at least 100%, 99.9%, 99.8%, 99.7%, 99.6%, 99.5%, 99.4%, 99.3%, 99.2%, 99.1%, 99%, 98%, 97%, 96%, 95%, 94%, 93%, 92%, 91%, 90%, 85%, 80%, 75%, 70%, 65%, 60%, 55%, 50%, 45%, 40%, 35%, 30%, 25%, or at least 20% sequence identity to any one of SEQ ID NOs: 2632-2819, and a VL-CDR3 comprising a sequence with at least 100%, 99.9%, 99.8%, 99.7%, 99.6%, 99.5%, 99.4%, 99.3%, 99.2%, 99.1%, 99%, 98%, 97%, 96%, 95%, 94%, 93%, 92%, 91%, 90%, 85%, 80%, 75%, 70%, 65%, 60%, 55%, 50%, 45%, 40%, 35%, 30%, 25%, or at least 20% sequence identity to a sequence of SEQ ID NO: 251-438.

In some embodiments, an anti-CD131 antibody can comprise a VH-CDR1 comprising a sequence with at least 100%, 99.9%, 99.8%, 99.7%, 99.6%, 99.5%, 99.4%, 99.3%, 99.2%, 99.1%, 99%, 98%, 97%, 96%, 95%, 94%, 93%, 92%, 91%, 90%, 85%, 80%, 75%, 70%, 65%, 60%, 55%, 50%, 45%, 40%, 35%, 30%, 25%, or at least 20% sequence identity to any one of SEQ ID NOs: 2820-2948, a VH-CDR2 comprising a sequence with at least 100%, 99.9%, 99.8%, 99.7%, 99.6%, 99.5%, 99.4%, 99.3%, 99.2%, 99.1%, 99%, 98%, 97%, 96%, 95%, 94%, 93%, 92%, 91%, 90%, 85%, 80%, 75%, 70%, 65%, 60%, 55%, 50%, 45%, 40%, 35%, 30%, 25%, or at least 20% sequence identity to any one of SEQ ID NOs: 2949-3077, and a VH-CDR3 comprising a sequence with at least 100%, 99.9%, 99.8%, 99.7%, 99.6%, 99.5%, 99.4%, 99.3%, 99.2%, 99.1%, 99%, 98%, 97%, 96%, 95%, 94%, 93%, 92%, 91%, 90%, 85%, 80%, 75%, 70%, 65%, 60%, 55%, 50%, 45%, 40%, 35%, 30%, 25%, or at least 20% sequence identity to a sequence of SEQ ID NO: 815-943. In some embodiments, an anti-CD131 antibody can comprise a VL-CDR1 comprising a sequence with at least 100%, 99.9%, 99.8%, 99.7%, 99.6%, 99.5%, 99.4%, 99.3%, 99.2%, 99.1%, 99%, 98%, 97%, 96%, 95%, 94%, 93%, 92%, 91%, 90%, 85%, 80%, 75%, 70%, 65%, 60%, 55%, 50%, 45%, 40%, 35%, 30%, 25%, or at least 20% sequence identity to any one of SEQ ID NOs: 3078-3206, a VL-CDR2 comprising a sequence with at least 100%, 99.9%, 99.8%, 99.7%, 99.6%, 99.5%, 99.4%, 99.3%, 99.2%, 99.1%, 99%, 98%, 97%, 96%, 95%, 94%, 93%, 92%, 91%, 90%, 85%, 80%, 75%, 70%, 65%, 60%, 55%, 50%, 45%, 40%, 35%, 30%, 25%, or at least 20% sequence identity to any one of SEQ ID NOs: 3207-3335, and a VL-CDR3 comprising a sequence with at least 100%, 99.9%, 99.8%, 99.7%, 99.6%, 99.5%, 99.4%, 99.3%, 99.2%, 99.1%, 99%, 98%, 97%, 96%, 95%, 94%, 93%, 92%, 91%, 90%, 85%, 80%, 75%, 70%, 65%, 60%, 55%, 50%, 45%, 40%, 35%, 30%, 25%, or at least 20% sequence identity to a sequence of SEQ ID NO: 944-1072.

In some embodiments, an anti-EPOR antibody that binds to both EPO receptor subunit and CD131 subunit of a hetero-EPOR can comprise a VH-CDR1 comprising a sequence with at least 100%, 99.9%, 99.8%, 99.7%, 99.6%, 99.5%, 99.4%, 99.3%, 99.2%, 99.1%, 99%, 98%, 97%, 96%, 95%, 94%, 93%, 92%, 91%, 90%, 85%, 80%, 75%, 70%, 65%, 60%, 55%, 50%, 45%, 40%, 35%, 30%, 25%, or at least 20% sequence identity to any one of SEQ ID NOs: 3336-3471, a VH-CDR2 comprising a sequence with at least 100%, 99.9%, 99.8%, 99.7%, 99.6%, 99.5%, 99.4%, 99.3%, 99.2%, 99.1%, 99%, 98%, 97%, 96%, 95%, 94%, 93%, 92%, 91%, 90%, 85%, 80%, 75%, 70%, 65%, 60%, 55%, 50%, 45%, 40%, 35%, 30%, 25%, or at least 20% sequence identity to any one of SEQ ID NOs: 3472-3607, and a VH-CDR3 comprising a sequence with at least 100%, 99.9%, 99.8%, 99.7%, 99.6%, 99.5%, 99.4%, 99.3%, 99.2%, 99.1%, 99%, 98%, 97%, 96%, 95%, 94%, 93%, 92%, 91%, 90%, 85%, 80%, 75%, 70%, 65%, 60%, 55%, 50%, 45%, 40%, 35%, 30%, 25%, or at least 20% sequence identity to any one of SEQ ID NOs: 1331-1466. In some embodiments, an anti-EPOR antibody that binds to both EPO receptor subunit and CD131 subunit can comprise a VL-CDR1 comprising a sequence with at least 100%, 99.9%, 99.8%, 99.7%, 99.6%, 99.5%, 99.4%, 99.3%, 99.2%, 99.1%, 99%, 98%, 97%, 96%, 95%, 94%, 93%, 92%, 91%, 90%, 85%, 80%, 75%, 70%, 65%, 60%, 55%, 50%, 45%, 40%, 35%, 30%, 25%, or at least 20% sequence identity to any one of SEQ ID NOs: 3608-3743, a VL-CDR2 comprising a sequence with at least 100%, 99.9%, 99.8%, 99.7%, 99.6%, 99.5%, 99.4%, 99.3%, 99.2%, 99.1%, 99%, 98%, 97%, 96%, 95%, 94%, 93%, 92%, 91%, 90%, 85%, 80%, 75%, 70%, 65%, 60%, 55%, 50%, 45%, 40%, 35%, 30%, 25%, or at least 20% sequence identity to any one of SEQ ID NOs: 3744-3879, and a VL-CDR3 comprising a sequence with at least 100%, 99.9%, 99.8%, 99.7%, 99.6%, 99.5%, 99.4%, 99.3%, 99.2%, 99.1%, 99%, 98%, 97%, 96%, 95%, 94%, 93%, 92%, 91%, 90%, 85%, 80%, 75%, 70%, 65%, 60%, 55%, 50%, 45%, 40%, 35%, 30%, 25%, or at least 20% sequence identity to a sequence of SEQ ID NO: 1467-1602.

In some embodiments, an anti-EPOR antibody that binds to EPO receptor subunit of a hetero-EPOR can comprise a VH comprising an amino acid sequence with at least 100%, 99.9%, 99.8%, 99.7%, 99.6%, 99.5%, 99.4%, 99.3%, 99.2%, 99.1%, 99%, 98%, 97%, 96%, 95%, 94%, 93%, 92%, 91%, 90%, 85%, 80%, 75%, 70%, 65%, 60%, 55%, 50%, 45%, 40%, 35%, 30%, 25%, or at least 20% sequence identity to any one of VH sequences listed in Table 5. In some embodiments, an anti-EPOR antibody that binds to EPO receptor subunit of a hetero-EPOR can comprise a VL comprising an amino acid sequence with at least 100%, 99.9%, 99.8%, 99.7%, 99.6%, 99.5%, 99.4%, 99.3%, 99.2%, 99.1%, 99%, 98%, 97%, 96%, 95%, 94%, 93%, 92%, 91%, 90%, 85%, 80%, 75%, 70%, 65%, 60%, 55%, 50%, 45%, 40%, 35%, 30%, 25%, or at least 20% sequence identity to any one of VL sequences listed in Table 5. In some embodiments, an anti-EPOR antibody that binds to EPO receptor subunit of a hetero-EPOR can comprise a VH comprising an amino acid sequence of any one of SEQ ID NOs: 439-626 and a VL comprising an amino acid sequence of any one of SEQ ID NOs: 627-814.

In some embodiments, an anti-CD131 antibody can comprise a VH comprising an amino acid sequence with at least 100%, 99.9%, 99.8%, 99.7%, 99.6%, 99.5%, 99.4%, 99.3%, 99.2%, 99.1%, 99%, 98%, 97%, 96%, 95%, 94%, 93%, 92%, 91%, 90%, 85%, 80%, 75%, 70%, 65%, 60%, 55%, 50%, 45%, 40%, 35%, 30%, 25%, or at least 20% sequence identity to any one of VH sequences listed in Table 7. In some embodiments, an anti-CD131 antibody can comprise a VL comprising an amino acid sequence with at least 100%, 99.9%, 99.8%, 99.7%, 99.6%, 99.5%, 99.4%, 99.3%, 99.2%, 99.1%, 99%, 98%, 97%, 96%, 95%, 94%, 93%, 92%, 91%, 90%, 85%, 80%, 75%, 70%, 65%, 60%, 55%, 50%, 45%, 40%, 35%, 30%, 25%, or at least 20% sequence identity to any one of VL sequences listed in Table 7. In some embodiments, an anti-CD131 antibody can comprise a VH comprising an amino acid sequence of any one of SEQ ID NOs: 1073-1201 and a VL comprising an amino acid sequence of any one of SEQ ID NOs: 1202-1330.

In some embodiments, an anti-EPOR antibody that binds to both EPO receptor subunit and CD131 subunit of a hetero-EPOR can comprise a VH comprising an amino acid sequence with at least 100%, 99.9%, 99.8%, 99.7%, 99.6%, 99.5%, 99.4%, 99.3%, 99.2%, 99.1%, 99%, 98%, 97%, 96%, 95%, 94%, 93%, 92%, 91%, 90%, 85%, 80%, 75%, 70%, 65%, 60%, 55%, 50%, 45%, 40%, 35%, 30%, 25%, or at least 20% sequence identity to any one of VH sequences listed in Table 9. In some embodiments, an anti-EPOR antibody that binds to both EPO receptor subunit and CD131 subunit of a hetero-EPOR can comprise a VL comprising an amino acid sequence with at least 100%, 99.9%, 99.8%, 99.7%, 99.6%, 99.5%, 99.4%, 99.3%, 99.2%, 99.1%, 99%, 98%, 97%, 96%, 95%, 94%, 93%, 92%, 91%, 90%, 85%, 80%, 75%, 70%, 65%, 60%, 55%, 50%, 45%, 40%, 35%, 30%, 25%, or at least 20% sequence identity to any one of VL sequences listed in Table 9. In some embodiments, an anti-EPOR antibody that binds to both EPO receptor subunit and CD131 subunit of a hetero-EPOR EPO receptor subunit of a hetero-EPOR can comprise a VH comprising an amino acid sequence of any one of SEQ ID NOs: 1603-1738 and a VL comprising an amino acid sequence of any one of SEQ ID NOs: 1739-1874.

In some embodiments, an anti-EPOR antibody, anti-CD131 antibody, or anti-EPO antibody can comprise a VH sequence and a kappa chain variable regions (VK) sequence. In some embodiments, an anti-EPOR antibody, anti-CD131 antibody, or anti-EPO antibody can comprise a VH sequence and a lamda chain variable regions. In some embodiments, an anti-EPOR antibody, anti-CD131 antibody, or anti-EPO antibody can comprise a VH sequence with at least 100%, 99.9%, 99.8%, 99.7%, 99.6%, 99.5%, 99.4%, 99.3%, 99.2%, 99.1%, 99%, 98%, 97%, 96%, 95%, 94%, 93%, 92%, 91%, 90%, 85%, 80%, 75%, 70%, 65%, 60%, 55%, 50%, 45%, 40%, 35%, 30%, 25%, or at least 20% sequence identity to any one of VH sequences listed in Table 10. In some embodiments, an anti-EPOR antibody, anti-CD131 antibody, or anti-EPO antibody can comprise a VH sequence of any one of SEQ ID NOs: 1875-1891. For example, an anti-EPOR antibody, anti-CD131 antibody, or anti-EPO antibody can comprise a VH sequence with at least 100%, 99.9%, 99.8%, 99.7%, 99.6%, 99.5%, 99.4%, 99.3%, 99.2%, 99.1%, 99%, 98%, 97%, 96%, 95%, 94%, 93%, 92%, 91%, 90%, 85%, 80%, 75%, 70%, 65%, 60%, 55%, 50%, 45%, 40%, 35%, 30%, 25%, or at least 20% sequence identity to any one of VH sequences of any one of SEQ ID NOs: 1875-1891. In some embodiments, an anti-EPOR antibody, anti-CD131 antibody, or anti-EPO antibody can comprise a VK sequence with at least 100%, 99.9%, 99.8%, 99.7%, 99.6%, 99.5%, 99.4%, 99.3%, 99.2%, 99.1%, 99%, 98%, 97%, 96%, 95%, 94%, 93%, 92%, 91%, 90%, 85%, 80%, 75%, 70%, 65%, 60%, 55%, 50%, 45%, 40%, 35%, 30%, 25%, or at least 20% sequence identity to any one of VK sequences listed in Table 10. In some embodiments, an anti-EPOR antibody, anti-CD131 antibody, or anti-EPO antibody can comprise a VK sequence of any one of SEQ ID NOs: 1956-1972. For example, an anti-EPOR antibody, anti-CD131 antibody, or anti-EPO antibody can comprise a VK sequence with at least 100%, 99.9%, 99.8%, 99.7%, 99.6%, 99.5%, 99.4%, 99.3%, 99.2%, 99.1%, 99%, 98%, 97%, 96%, 95%, 94%, 93%, 92%, 91%, 90%, 85%, 80%, 75%, 70%, 65%, 60%, 55%, 50%, 45%, 40%, 35%, 30%, 25%, or at least 20% sequence identity to any one of VK sequences of any one of SEQ ID NOs: 1956-1972.

In some aspects, an anti-EPOR antibody, anti-CD131 antibody, or an anti-EPO antibody can bind to the hetero-EPOR or homo-EPOR or EPO (respectively) with an affinity of from about 1 pM to about 100 nM, from about 2.0 to about 5.1 nM, from about 45 nM to about 300 nM, or from about 2.0 to about 300 nM. In some embodiments, an anti-EPOR antibody, anti-CD131 antibody, or an anti-EPO antibody can bind with an affinity of at least about 300 nM, at least about 140 nM, at least about 100 nM, at least about 5.1 nm, at least about 3.8 nM, or at least about 2.4 nM. In some aspects, a binding affinity can be measured using any method known in the art. For example, a binding affinity can be measure using surface plasmon resonance (SPR; Biacore™, real time molecular interaction monitoring system for analysis of affinity and/or kinetics), KinExA™ Biosensor (system for measuring binding affinity KD), scintillation proximity assays, enzyme linked immunosorbent assay (ELISA), ORIGEN immunoassay (IGEN), fluorescence quenching, fluorescence transfer, yeast display, or any combination thereof. In some embodiments, a binding affinity can be screened using a suitable bioassay.

In some embodiments, anti-EPO antibodies, anti-EPOR antibodies, anti-CD131 antibodies described herein can have a binding affinity of less than about 600 nM, about 590 nM, about 580 nM, about 570 nM, about 560 nM, about 550 nM, about 540 nM, about 530 nM, about 520 nM, about 510 nM, about 500 nM, about 490 nM, about 480 nM, about 470 nM, about 460 nM, about 450 nM, about 440 nM, about 430 nM, about 420 nM, about 410 nM, about 400 nM, about 390 nM, about 380 nM, about 370 nM, about 360 nM, about 350 nM, about 340 nM, about 330 nM, about 320 nM, about 310 nM, about 300 nM, about 290 nM, about 280 nM, about 270 nM, about 260 nM, about 250 nM, about 240 nM, about 230 nM, about 220 nM, about 210 nM, about 200 nM, about 190 nM, about 180 nM, about 170 nM, about 160 nM, about 150 nM, about 140 nM, about 130 nM, about 120 nM, about 110 nM, about 100 nM, about 90 nM, about 80 nM, about 70 nM, about 50 nM, about 50 nM, about 49 nM, about 48 nM, about 47 nM, about 46 nM, about 45 nM, about 44 nM, about 43 nM, about 42 nM, about 41 nM, about 40 nM, about 39 nM, about 38 nM, about 37 nM, about 36 nM, about 35 nM, about 34 nM, about 33 nM, about 32 nM, about 31 nM, about 30 nM, about 29 nM, about 28 nM, about 27 nM, about 26 nM, about 25 nM, about 24 nM, about 23 nM, about 22 nM, about 21 nM, about 20 nM, about 19 nM, about 18 nM, about 17 nM, about 16 nM, about 15 nM, about 14 nM, about 13 nM, about 12 nM, about 11 nM, about 10 nM, about 9 nM, about 8 nM, about 7 nM, about 6 nM, about 5 nM, about 4 nM, about 3 nM, about 2 nM, about 1 nM, about 990 pM, about 980 pM, about 970 pM, about 960 pM, about 950 pM, about 940 pM, about 930 pM, about 920 pM, about 910 pM, about 900 pM, about 890 pM, about 880 pM, about 870 pM, about 860 pM, about 850 pM, about 840 pM, about 830 pM, about 820 pM, about 810 pM, about 800 pM, about 790 pM, about 780 pM, about 770 pM, about 760 pM, about 750 pM, about 740 pM, about 730 pM, about 720 pM, about 710 pM, about 700 pM, about 690 pM, about 680 pM, about 670 pM, about 660 pM, about 650 pM, about 640 pM, about 630 pM, about 620 pM, about 610 pM, about 600 pM, about 590 pM, about 580 pM, about 570 pM, about 560 pM, about 550 pM, about 540 pM, about 530 pM, about 520 pM, about 510 pM, about 500 pM, about 490 pM, about 480 pM, about 470 pM, about 460 pM, about 450 pM, about 440 pM, about 430 pM, about 420 pM, about 410 pM, about 400 pM, about 390 pM, about 380 pM, about 370 pM, about 360 pM, about 350 pM, about 340 pM, about 330 pM, about 320 pM, about 310 pM, about 300 pM, about 290 pM, about 280 pM, about 270 pM, about 260 pM, about 250 pM, about 240 pM, about 230 pM, about 220 pM, about 210 pM, about 200 pM, about 190 pM, about 180 pM, about 170 pM, about 160 pM, or any integer therebetween. In some embodiments, anti-EPO antibodies, anti-EPOR antibodies, anti-CD131 antibodies described herein can have a binding affinity of less than 150 pM, about 140 pM, about 130 pM, about 120 pM, about 110 pM, about 100 pM, about 95 pM, about 90 pM, about 85 pM, about 80 pM, about 75 pM, about 70 pM, about 65 pM, about 60 pM, about 55 pM, about 50 pM about 45 pM, about 40 pM, about 35 pM, about 30 pM, about 25 pM, about 20 pM, about 15 pM, about 10 pM, about 9 pM, about 8 pM, about 7 pM, about 6 pM, about 5 pM, about 4 pM, about 3 pM, about 2 pM, about 1 pM, about 0.9 pM, about 0.8 pM, about 0.7 pM, about 0.6 pM, about 0.5 pM, about 0.4 pM, about 0.3 pM, about 0.2 pM, about 0.1 pM, about 0.09 pM, about 0.08, about 0.07 pM, about 0.06 pM, about 0.05 pM, about 0.04 pM, about 0.03 pM, about 0.02 pM, about 0.01 pM, or any integer therebetween.

In some instances, anti-EPO antibodies, anti-EPOR antibodies, or anti-CD131 antibodies described herein can have antagonistic effects. In some embodiments, anti-EPO antibodies described herein can bind EPOs and inhibit or block EPO/EPOR interaction. For example, anti-EPO antibodies can bind EPOs and inhibit EPOs from binding to homo-EPORs or hetero-EPORs. In some embodiments, the level of inhibition is at least about 1%, at least about 5%, at least about 10%, at least about 15%, at least about 20%, at least about 25%, at least about 30%, at least about 35%, at least about 40, at least about 45%, at least about 50%, at least about 55%, at least about 60%, at least about 65%, at least about 70%, at least about 71%, at least about 72%, at least about 73%, at least about 74%, at least about 75%, at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 94%, at least about 95%, at least about 96%, at least about 97%, at least about 98%, at least about 99%, or at least about 100%.

In some embodiments, anti-EPOR antibodies described herein can bind EPOR subunits of homo-EPORs or hetero-EPORs and inhibit or block homo-EPOR complex formation, hetero-EPOR complex formation, EPO/homo-EPOR interaction, or EPO/hetero-EPOR interaction. For example, anti-EPOR antibodies can bind EPOR subunits and inhibit formation of homo-EPORs or hetero-EPORs. For example, anti-EPOR antibodies can bind EPOR subunits of homo-EPORs or hetero-EPORs and inhibit homo-EPORs or hetero-EPORs from binding to EPOs. In some embodiments, the level of inhibition is at least about 1%, at least about 5%, at least about 10%, at least about 15%, at least about 20%, at least about 25%, at least about 30%, at least about 35%, at least about 40, at least about 45%, at least about 50%, at least about 55%, at least about 60%, at least about 65%, at least about 70%, at least about 71%, at least about 72%, at least about 73%, at least about 74%, at least about 75%, at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 94%, at least about 95%, at least about 96%, at least about 97%, at least about 98%, at least about 99%, or at least about 100%.

In some embodiments, anti-CD131 antibodies described herein can bind CD131 and inhibit or block hetero-EPOR complex formation or EPO/hetero-EPOR interaction. For example, anti-CD131 antibodies can bind CD131 and inhibit formation of hetero-EPORs. For example, anti-CD131 antibodies can bind CD131 subunits of hetero-EPORs and inhibit hetero-EPORs from binding to EPOs. In some embodiments, the level of inhibition is at least about 1%, at least about 5%, at least about 10%, at least about 15%, at least about 20%, at least about 25%, at least about 30%, at least about 35%, at least about 40, at least about 45%, at least about 50%, at least about 55%, at least about 60%, at least about 65%, at least about 70%, at least about 71%, at least about 72%, at least about 73%, at least about 74%, at least about 75%, at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 94%, at least about 95%, at least about 96%, at least about 97%, at least about 98%, at least about 99%, or at least about 100%.

In some instances, anti-EPO antibodies, anti-EPOR antibodies, or anti-CD131 antibodies described herein can have agonistic effects. In some embodiments, anti-EPO antibodies described herein can bind EPOs and enhance or promote EPO/EPOR interaction. In some embodiments, EPO/EPOR interaction is enhanced by at least about 1%, at least about 5%, at least about 10%, at least about 15%, at least about 20%, at least about 25%, at least about 30%, at least about 35%, at least about 40, at least about 45%, at least about 50%, at least about 55%, at least about 60%, at least about 65%, at least about 70%, at least about 71%, at least about 72%, at least about 73%, at least about 74%, at least about 75%, at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 94%, at least about 95%, at least about 96%, at least about 97%, at least about 98%, at least about 99%, or at least about 100% with anti-EPO antibodies.

In some embodiments, anti-EPOR antibodies described herein can bind EPOR subunits of homo-EPORs or hetero-EPORs and enhance or promote homo-EPOR complex formation, hetero-EPOR complex formation, EPO/homo-EPOR interaction, or EPO/hetero-EPOR interaction. In some embodiments, the homo-EPOR complex formation, hetero-EPOR complex formation, EPO/homo-EPOR interaction, or EPO/hetero-EPOR interaction is enhanced by at least about 1%, at least about 5%, at least about 10%, at least about 15%, at least about 20%, at least about 25%, at least about 30%, at least about 35%, at least about 40, at least about 45%, at least about 50%, at least about 55%, at least about 60%, at least about 65%, at least about 70%, at least about 71%, at least about 72%, at least about 73%, at least about 74%, at least about 75%, at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 94%, at least about 95%, at least about 96%, at least about 97%, at least about 98%, at least about 99%, or at least about 100% with anti-EPOR antibodies.

In some embodiments, anti-CD131 antibodies described herein can bind CD131 and enhance or promote hetero-EPOR complex formation or EPO/hetero-EPOR interaction. In some embodiments, hetero-EPOR complex formation or EPO/hetero-EPOR interaction is enhanced by at least about 1%, at least about 5%, at least about 10%, at least about 15%, at least about 20%, at least about 25%, at least about 30%, at least about 35%, at least about 40, at least about 45%, at least about 50%, at least about 55%, at least about 60%, at least about 65%, at least about 70%, at least about 71%, at least about 72%, at least about 73%, at least about 74%, at least about 75%, at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 94%, at least about 95%, at least about 96%, at least about 97%, at least about 98%, at least about 99%, or at least about 100% with anti-CD131 antibodies.

In some embodiments, affinity maturation can be used with an antibody disclosed herein to obtain an anti-EPOR antibody, anti-CD131, or an anti-EPO antibody of a desired affinity. When an anti-EPOR antibody, anti-CD131, or anti-EPO antibody is obtained from an animal (e.g., a transgenic animal carrying a human antibody repertoire), the antibodies made in the transgenic animal can undergo affinity maturation. Alternatively, antibodies from a transgenic animal, or from other technologies (such as a display technology) can be affinity matured using chain shuffling approaches and/or mutation of the nucleic acids encoding VH and VL followed by screening and/or selecting for antibodies with greater affinity.

The most widely used methods for minimizing the immunogenicity of non-human antibodies while retaining specificity and affinity can involve grafting the CDRs of the non-human antibody onto human frameworks typically selected for their structural homology to the non-human framework (Jones et al., 1986, Nature 321:522-5; U.S. Pat. No. 5,225,539, both of which are hereby incorporated by reference in their entirety). The inclusion of some non-human residues at key positions in the framework can improve the affinity of the CDR grafted antibody (Bajorath et al., 1995, J Biol Chem 270:22081-4; Martin et al., 1991, Methods Enzymol. 203:121-53; Al-Lazikani, 1997, J Mol Biol 273:927-48, all of which are hereby incorporated by reference in their entirety). Exemplary methods for humanization of antibodies by CDR grafting are disclosed, for example, in U.S. Pat. No. 6,180,370, which is hereby incorporated by reference in its entirety.

Improvements to the traditional CDR-grafting approaches can use various hybrid selection approaches, in which portions of the non-human antibody have been combined with libraries of complementary human antibody sequences in successive rounds of selection for antigen binding, in the course of which most of the non-human sequences are gradually replaced with human sequences. For example, in the chain-shuffling technique (Marks, et al., 1992, Biotechnology 10:779-83, which is hereby incorporated by reference in its entirety for all purposes) one chain of the non-human antibody can be combined with a naive human repertoire of the other chain on the rationale that the affinity of the non-human chain will be sufficient to constrain the selection of a human partner to the same epitope on the antigen. Selected human partners can then be used to guide selection of human counterparts for the remaining non-human chains.

Other methodologies can include chain replacement techniques where the non-human CDR3s were retained and only the remainder of the V-regions, including the frameworks and CDRs 1 and 2, were individually replaced in steps performed sequentially (e.g., U.S. Patent Application No. 20030166871; Rader, et al., Proc. Natl. Acad. Sci. USA 95:8910-15, 1998; Steinberger, et al., J. Biol. Chem. 275: 36073-36078, 2000; Rader, et al., J. Biol. Chem. 275:13668-13676, 2000, all of which are hereby incorporated by reference in their entirety for all purposes).

These technologies can be used to make antibodies suitable for use in non-human subjects by engineering the CDRs into framework regions of the subject species using analogous approaches to the CDR grafting methods used for making antibodies for use in humans.

The disclosure encompasses pharmaceutically acceptable salts of anti-EPOR antibodies, anti-CD131 antibodies, or anti-EPO antibodies, including those with a positive net charge, those with a negative net charge, and those with no net charge, and including, without limitation, salts of anti-EPOR antibodies, anti-CD131 antibodies, or anti-EPO antibodies including fragments thereof as compounds, in pharmaceutical compositions, in their therapeutic and diagnostic uses, and in their production.

In some embodiments, anti-EPO antibodies, anti-EPOR antibodies, anti-CD131 antibodies described herein can have a half-life of from 1 minute to 1 hour in human plasma. In some embodiments, anti-EPO antibodies, anti-EPOR antibodies, anti-CD131 antibodies described herein can have a half-life of about 1 minute to 2 minutes, about 1 minute to about 4 minutes, about 1 minute to about 5 minutes, about 1 minute to about 10 minutes, about 1 minute to about 15 minutes, about 1 minute to about 20 minutes, about 1 minute to about 25 minutes, about 1 minute to about 30 minutes, about 1 minute to about 35 minutes, about 1 minute to about 40 minutes, about 1 minute to about 45 minutes, about 1 minute to about 50 minutes, about 1 minute to about 55 minutes, or about 1 minute to about 1 hour. In some embodiments, anti-EPO antibodies, anti-EPOR antibodies, anti-CD131 antibodies described herein can have a half-life of about 1 minute, about 2 minutes, about 3 minutes, about 4 minutes, about 5 minutes, about 10 minutes, about 15 minutes, about 20 minutes, about 25 minutes, about 30 minutes, about 35 minutes, about 40 minutes, about 45 minutes, about 50 minutes, about 55 minutes, or about 1 hour. In some embodiments, anti-EPO antibodies, anti-EPOR antibodies, anti-CD131 antibodies described herein can have a half-life of from 1 hour to 5 days in human plasma. In some embodiments, anti-EPO antibodies, anti-EPOR antibodies, anti-CD131 antibodies described herein can have a half-life about 1 hour to about 120 hours. In some embodiments, anti-EPO antibodies, anti-EPOR antibodies, anti-CD131 antibodies described herein can have a half-life about 1 hour to about 5 hours, about 1 hour to about 10 hours, about 1 hour to about 12 hours, about 1 hour to about 24 hours, about 1 hour to about 36 hours, about 1 hour to about 48 hours, about 1 hour to about 60 hours, about 1 hour to about 72 hours, about 1 hour to about 84 hours, about 1 hour to about 96 hours, about 1 hour to about 120 hours, about 5 hours to about 10 hours, about 5 hours to about 12 hours, about 5 hours to about 24 hours, about 5 hours to about 36 hours, about 5 hours to about 48 hours, about 5 hours to about 60 hours, about 5 hours to about 72 hours, about 5 hours to about 84 hours, about 5 hours to about 96 hours, about 5 hours to about 120 hours, about 10 hours to about 12 hours, about 10 hours to about 24 hours, about 10 hours to about 36 hours, about 10 hours to about 48 hours, about 10 hours to about 60 hours, about 10 hours to about 72 hours, about 10 hours to about 84 hours, about 10 hours to about 96 hours, about 10 hours to about 120 hours, about 12 hours to about 24 hours, about 12 hours to about 36 hours, about 12 hours to about 48 hours, about 12 hours to about 60 hours, about 12 hours to about 72 hours, about 12 hours to about 84 hours, about 12 hours to about 96 hours, about 12 hours to about 120 hours, about 24 hours to about 36 hours, about 24 hours to about 48 hours, about 24 hours to about 60 hours, about 24 hours to about 72 hours, about 24 hours to about 84 hours, about 24 hours to about 96 hours, about 24 hours to about 120 hours, about 36 hours to about 48 hours, about 36 hours to about 60 hours, about 36 hours to about 72 hours, about 36 hours to about 84 hours, about 36 hours to about 96 hours, about 36 hours to about 120 hours, about 48 hours to about 60 hours, about 48 hours to about 72 hours, about 48 hours to about 84 hours, about 48 hours to about 96 hours, about 48 hours to about 120 hours, about 60 hours to about 72 hours, about 60 hours to about 84 hours, about 60 hours to about 96 hours, about 60 hours to about 120 hours, about 72 hours to about 84 hours, about 72 hours to about 96 hours, about 72 hours to about 120 hours, about 84 hours to about 96 hours, about 84 hours to about 120 hours, or about 96 hours to about 120 hours. In some embodiments, anti-EPO antibodies, anti-EPOR antibodies, anti-CD131 antibodies described herein can have a half-life about 1 hour, about 5 hours, about 10 hours, about 12 hours, about 24 hours, about 36 hours, about 48 hours, about 60 hours, about 72 hours, about 84 hours, about 96 hours, or about 120 hours. In some embodiments, anti-EPO antibodies, anti-EPOR antibodies, anti-CD131 antibodies described herein can have a half-life at least about 1 hour, about 5 hours, about 10 hours, about 12 hours, about 24 hours, about 36 hours, about 48 hours, about 60 hours, about 72 hours, about 84 hours, or about 96 hours. In some embodiments, anti-EPO antibodies, anti-EPOR antibodies, anti-CD131 antibodies described herein can have a half-life at most about 5 hours, about 10 hours, about 12 hours, about 24 hours, about 36 hours, about 48 hours, about 60 hours, about 72 hours, about 84 hours, about 96 hours, or about 120 hours. In some embodiments, anti-EPO antibodies, anti-EPOR antibodies, anti-CD131 antibodies described herein can have a half-life at least about 10 days, about 11 days, about 11 days, 12 days, 13 days, 14 days, 15 days, 16 days, 17 days, 18 days, 19 days, or 20 days. In some embodiments, anti-EPO antibodies, anti-EPOR antibodies, anti-CD131 antibodies described herein can have a half-life at about 10 days to about 11 days, about 10 to about 12 days, about 10 days to about 13 days, 10 days to about 14 days, about 10 days to about 15 days, about 10 days to about 16 days, about 10 days to about 17 days, about 10 days to about 18 days, about 10 days to about 19 days, or about 10 days to about 20 days. In some embodiments, anti-EPO antibodies, anti-EPOR antibodies, anti-CD131 antibodies described herein can have a half-life at about 14 days to about 17 days.

The disclosure also encompasses bispecific or multispecific antibodies that can have specificity for at least two antigens. For example, anti-EPO antibodies, anti-EPOR antibodies, anti-CD131 antibodies described herein can be generated as bispecific antibodies that can also bind another target. In some embodiments, anti-EPO antibodies, anti-EPOR antibodies, anti-CD131 antibodies described herein can be generated as bispecific antibodies that can also bind a cell surface marker associated with immune cells, a signaling molecule associated with immune cells, or an antigen associated with tumor. In some embodiments, bispecific antibodies described herein can enhance specificity and/or selectivity of anti-EPO, anti-EPOR, anti-CD131 antibodies described herein. For example, bispecific antibodies that can bind a cell surface marker of immune cells and any of EPO, homo-EPOR, hetero-EPOR can be used to target EPO, homo-EPOR, or hetero-EPOR in immune cells. For example, bispecific antibodies that can bind a signaling molecule of immune cells and any of EPO, homo-EPOR, hetero-EPOR can be used to target EPO, homo-EPOR, or hetero-EPOR in immune cells. For example, bispecific antibodies that can bind an antigen associated with tumor and any of EPO, homo-EPOR, hetero-EPOR can be used to target EPO, homo-EPOR, or hetero-EPOR in tumor or cancer cells.

In some embodiments, a bispecific antibody can bind (i) EPO, EPO receptor subunit of a homo-EPOR or a hetero-EPOR, CD131 subunit of a hetero-EPOR, a homo-EPOR, a hetero EPOR; and (ii) a cell surface marker associated with immune cells. Examples of cell surface markers associated with immune cells can include, but are not limited to, lymphocyte antigen 75 (DEC205), X-C motif chemokine receptor 1 (XCR1), or X-C motif chemokine ligand 1 (XCL1). In some embodiments, bispecific antibodies described herein can enhance specificity and/or selectivity of anti-EPO, anti-EPOR, anti-CD131 antibodies described herein for targeting immune cells. For example, bispecific antibodies that can bind a cell surface marker associated with immune cells and any of EPO, homo-EPOR, hetero-EPOR can be used to target EPO, homo-EPOR, or hetero-EPOR in immune cells. In some embodiments, bispecific antibodies described herein can specifically and/or selectively target EPO, homo-EPOR, or hetero-EPOR in immune cells and specifically and/or selectively increase or decrease homo-EPOR activity or hetero-EPOR activity described herein in immune cells. In some embodiments, bispecific antibodies described herein can be used to enhance specificity and/or selectivity of agonistic anti-EPO, anti-EPOR, anti-CD131 binding described herein in immune cells to promote immune tolerance before/after organ transplant (e.g., bone marrow, kidney, heart, lung, liver, etc.). In some embodiments, immune cells can comprise macrophages, dendritic cells, T-cells, natural killer cells, or B cells.

In some embodiments, a bispecific antibody can bind (i) EPO, EPO receptor subunit of a homo-EPOR or a hetero-EPOR, CD131 subunit of a hetero-EPOR, a homo-EPOR, a hetero EPOR; and (ii) a signaling molecule associated with immune cells. Examples of signaling molecules associated with immune cells can include, but are not limited to, Programmed Death Ligand 1 (PD-L1), T-cell immunoglobulin and mucin-domain containing 3 (Tim3), or Triggering receptor expressed on myeloid cells 2 (TREM2). In some embodiments, bispecific antibodies described herein can enhance specificity and/or selectivity of anti-EPO, anti-EPOR, anti-CD131 antibodies described herein for targeting immune cells. For example, bispecific antibodies that can bind a signaling molecule associated with immune cells and any of EPO, homo-EPOR, hetero-EPOR can be used to target EPO, homo-EPOR, or hetero-EPOR in immune cells and can have synergistic anti-cancer effect. In some embodiments, bispecific antibodies described herein can specifically and/or selectively target EPO, homo-EPOR, or hetero-EPOR in immune cells and specifically and/or selectively increase or decrease homo-EPOR activity or hetero-EPOR activity described herein in immune cells. For example, bispecific antibodies described herein can be used to specifically and/or selectively target EPO, homo-EPOR, or hetero-EPOR in immune cells and specifically and/or selectively increase hetero-EPOR activity to stimulate immune response in cancer. In some embodiments, immune cells can comprise macrophages, dendritic cells, T-cells, natural killer cells, or B cells.

In some embodiments, a bispecific antibody can bind (i) EPO, EPO receptor subunit of a homo-EPOR or a hetero-EPOR, CD131 subunit of a hetero-EPOR, a homo-EPOR, a hetero EPOR; and (ii) a tumor marker or an antigen associated with tumor. Examples of tumor markers or antigens associated with tumor can include, but are not limited to, PD1, HER2, CEA, CEACAM5, CD19, CD20, CD22, prostate specific antigen (PSA), CD123, CLL-1, B cell maturation antigen, CD138, CD133 (PROM1), CD44, ALDH1A1, CD34, CD24, EpCAM (ESA), CD 117 (KIT), CD90 (THY1), CD166 (ALCAM), PDXL-1, PTCH, CD87 (PLAUR), SSEA-1, EGFR, SP, ALDH, CD49, CD326, LGR5, ALDH1A, LETM1, NANOG, POU5F1, SALL4, SOX2, LINGO2, AFP, NOTCH1, NOTCH2, NOTCH3, CTNNBL1, CD29, CD25, CD61, PROCR, TSPAN8, BMI1, FOXO1, FOXO3, FOXO4, CD15 (FUT4), CHL1, KLF4, NES, TACSTD2, TGM2, CD36, IL1RAP, GLI2, TET2, DNMT3A, KRAS, LDHB, LDHC, LDHD, NPM1, CD33, CD49f, CD171, ABCG2, FZD, CXCR4, OCT4, ALDH, E-cadherin, CD200, ABCB5, vimentin, CD146, CD31, CD144, or CD201 (PROCR). In some embodiments, bispecific antibodies described herein can enhance specificity and/or selectivity of anti-EPO, anti-EPOR, anti-CD131 antibodies described herein for targeting tumors. For example, bispecific antibodies that can bind a tumor associated antigen and any of EPO, homo-EPOR, hetero-EPOR can be used to target EPO, homo-EPOR, or hetero-EPOR in cancer or tumor cells. In some embodiments, tumor associated antigens can be on cancer or tumor cells (e.g., on cell membrane) or secreted by cancer or tumor cells. In some embodiments, bispecific antibodies described herein can specifically and/or selectively target EPO, homo-EPOR, or hetero-EPOR in cancer or tumor cells and specifically and/or selectively increase or decrease homo-EPOR activity or hetero-EPOR activity described herein in cancer or tumor cells.

The disclosure also encompasses a composition comprising a combination or a population of antibodies or functional fragments thereof described herein. For example, a composition can comprise one, two, three, four, five, six, seven, eight, nine, ten, or more different antibodies or functional fragments thereof. In one embodiment, a composition can comprise one antibody or a functional fragment thereof described herein. In another embodiment, a composition can comprise a combination or a population of antibodies or functional fragments comprising two different antibodies or functional fragments thereof. In another embodiment, a composition can comprise a combination or a population of antibodies or functional fragments thereof comprising three different antibodies or functional fragments thereof. In yet another embodiment, a composition can comprise a combination or a population of antibodies or functional fragments thereof comprising four, five, six, seven, eight, nine, ten, or more than ten different antibodies or functional fragments thereof. In some embodiments, each of the one, two, three, four, five, six, seven, eight, nine, ten, or more different antibodies or functional fragments thereof can bind to the same target (e.g., EPO protein, a EPO receptor subunit, or a CD131 subunit, etc.). In some embodiments, each of the one, two, three, four, five, six, seven, eight, nine, ten, or more different antibodies or functional fragments thereof can bind to a different part of the same target (e.g., EPO protein, a EPO receptor subunit, or a CD131 subunit, etc.). In some embodiments, each of the one, two, three, four, five, six, seven, eight, nine, ten, or more different antibodies or functional fragments thereof can bind to a different target (e.g., EPO protein, a EPO receptor subunit, a CD131 subunit, or a combination thereof). In some embodiments, at least two of the one, two, three, four, five, six, seven, eight, nine, ten, or more different antibodies or functional fragments thereof can bind to the same target (e.g., EPO protein, a EPO receptor subunit, or a CD131 subunit, etc.) and at least two of the one, two, three, four, five, six, seven, eight, nine, ten, or more different antibodies or functional fragments thereof can bind to a different target (e.g., EPO protein, a EPO receptor subunit, a CD131 subunit, or a combination thereof). In some embodiments, at least two of the one, two, three, four, five, six, seven, eight, nine, ten, or more different antibodies or functional fragments thereof can bind to the same target (e.g., EPO protein, a EPO receptor subunit, or a CD131 subunit, etc.), wherein each of the at least two of the one, two, three, four, five, six, seven, eight, nine, ten, or more different antibodies or functional fragments thereof can bind to a different part of the same target, and at least two of the one, two, three, four, five, six, seven, eight, nine, ten, or more different antibodies or functional fragments thereof can bind to a different target (e.g., EPO protein, a EPO receptor subunit, a CD131 subunit, or a combination thereof).

Modifications of Antibodies

Antibodies described herein can have one or more modifications that can enhance their activity, binding, specificity, selectivity, or another feature. In some aspects, an anti-EPOR antibody, and/or an anti-CD131 antibody, and/or an anti-EPO antibody, and/or an engineered EPO can include a moiety that extends a half-life ($T_{1/2}$) or/and the duration of action of the antibody. In some embodiments, the moiety can extend the circulation $T_{1/2}$, blood $T_{1/2}$, plasma $T_{1/2}$, serum $T_{1/2}$, terminal $T_{1/2}$, biological $T_{1/2}$, elimination $T_{1/2}$ or functional $T_{1/2}$, or any combination thereof, of the antibody. In some embodiments, an Fc portion of an antibody described herein can be modified to extend half-life of the antibody.

In one aspect, an anti-EPOR antibody and/or anti-CD131 antibody and/or an anti-EPO antibody and/or an engineered EPO may be modified by a single moiety. In another aspect, an anti-EPOR antibody and/or an anti-CD131 antibody and/or an anti-EPO antibody and/or an engineered EPO may be modified by two or more substantially similar or identical moieties or two or more moieties of the same type. In some embodiments, an anti-EPOR antibody and/or an anti-CD131 antibody and/or an anti-EPO antibody and/or an engineered EPO may include two or more moieties of different types, or two or more different types of moieties. In some embodiments, two or more anti-EPOR antibodies and/or anti-CD131 antibodies and/or anti-EPO antibodies and/or engineered EPOs can also be attached to one moiety. In some embodiments, the attachment between the anti-EPOR antibody and/or anti-CD131 antibody and/or anti-EPO antibody and/or engineered EPO and the moiety can be covalent or noncovalent.

In some aspects, a polypeptide moiety can be recombinantly fused to the N-terminus or the C-terminus of the heavy chain or the light chain of an anti-EPOR antibody and/or an anti-CD131 antibody and/or an anti-EPO antibody and/or an engineered EPO, optionally via a linker. In some embodiments, the linker may comprise about 4-30 amino acid residues. For example, the linker may comprise from about 6 or 8 amino acid residues to about 20 amino acid residues, or from about 6 or 8 amino acid residues to about 15 amino acid residues.

In some aspects, a protracting moiety can be human serum albumin (HSA) or a portion thereof (e.g., domain III) that binds to the neonatal Fc receptor (FcRn). The HSA or FcRn-binding portion thereof can optionally have one or more mutations that confer a beneficial property or effect. In some embodiments, the HSA or FcRn-binding portion thereof can comprise one or more mutations that can enhance pH-dependent HSA binding to FcRn or/and increase HSA half-life, such as K573P or/and E505G/V547A. In some embodiments, a protracting moiety can be an unstructured polypeptide.

In some aspects, a protracting moiety can be a carboxy-terminal peptide (CTP) derived from the β-subunit of human chorionic gonadotropin (hCG). In the human body, the fourth, fifth, seventh and eight serine residues of the 34-aa CTP of hCG-β typically are attached to O-glycans terminating with a sialic acid residue.

In some aspects, a protracting moiety can be 1, 2, 3, 4, 5, or more moieties of a synthetic polymer. In some embodiments, the synthetic polymer can be biodegradable or non-biodegradable. Biodegradable polymers useful as protracting moieties can include, but are not limited to, poly(2-methacryloyloxyethyl phosphorylcholine) (PMPC) and poly [oligo(ethylene glycol) methyl ether methacrylate] (POEGMA). Non-biodegradable polymers useful as protracting moieties include without limitation poly(ethylene glycol)(PEG), polyglycerol, poly(N-(2-hydroxypropyl) methacrylamide) (PHPMA), polyoxazolines and poly(N-vinylpyrrolidone) (PVP). In some embodiments, a synthetic polymer can be polyethylene glycol (PEG). PEGylation can be done by chemical or enzymatic, site-specific coupling or by random coupling.

In some embodiments, the individual mass (e.g., average molecular weight), or the total mass, of the one or more synthetic polymer moieties can be about 10-50 kDa, about 10-20 kDa, about 20-30 kDa, about 30-40 kDa, or kDa 40-50 kDa. In some embodiments, the individual mass (e.g., average molecular weight), or the total mass, of the one or more synthetic polymer moieties can be about 10 kDa, about 20 kDa, about 30 kDa, about 40 kDa, or 50 kDa. In some embodiments, the individual mass (e.g., average MW), or the total mass, of the one or more synthetic polymer moieties can be greater than about 50 kDa, such as about 50-100 kDa, about 50-60 kDa, about 60-70 kDa, about 70-80 kDa, about 80-90 kDa, or about 90-100 kDa. In some embodiments, the individual mass (e.g., average molecular weight), or the total mass, of the one or more synthetic polymer moieties can be about 60 kDa, about 70 kDa, about 80 kDa, about 90 kDa, or about 100 kDa. In some embodiments, the mass (e.g., average MW) of an individual synthetic polymer moiety can be less than about 10 kDa, such as about 1-5 kDa, about 5-10 kDa, or about 5 kDa. In some embodiments, the individual mass (e.g., average MW), or the total mass, of the one or more synthetic polymer (e.g., PEG) moieties can be about 20 kDa or about 40 kDa.

In some aspects, modified antibodies can comprise a human modified antibody. In some aspects, also provided herein are amino acid sequence variants of modified antibodies which can be prepared by introducing appropriate nucleotide changes into the DNA sequence of modified antibodies, or by synthesis of the desired modified antibody polypeptides. In some embodiments, such variants can include, for example, a deletion, an insertion, or a substitution of one or more residues within the amino acid sequence of an antibody. In some embodiments, any combinations of deletion, insertion, and substitution can be made to generate an antibody that can have desired antigen-binding characteristics. The amino acid changes of a modified antibody can also alter post-translational processes of the modified antibody, including, but are not limited to, changing the number or position of glycosylation sites. In some embodiments, alanine scanning mutagenesis can be used to identify one or more residues or regions of a modified antibody that may be preferred locations for mutagenesis. In some embodiments, a residue or a group of target residues can be identified (e.g., charged residues such as Arg, Asp, His, Lys, and Glu) and replaced by a neutral or negatively charged amino acid (e.g., alanine or polyalanine) to affect an interaction of the amino acids with the surrounding aqueous environment in or outside a cell. In some embodiments, one or more domains demonstrating functional sensitivity to amino acid substitutions can be refined by introducing further amino acid substitution or other substitutions. In some embodiments, amino acid substitutions can include one or more conservative amino acid replacements in non-functional regions of an modified antibody.

In some aspects, modifications of antibodies described herein can be covalent modifications. In some embodiments, covalent modifications can be introduced by reacting one or more targeted amino acid residues of an antibody or functional fragment thereof with an organic derivatizing agent that can be capable of reacting with selected side chains or the N- or C-terminal residues. In some embodiments, covalent modifications can be introduced by altering the native glycosylation pattern of an antibody. For example, one or more carbohydrate moieties can be deleted from an antibody. For example, one or more glycosylation sites that are not present in an antibody can be added. In some embodiments, addition of glycosylation sites to an antibody can be accomplished by altering the amino acid sequence such that it contains one or more N-linked glycosylation sites. In some embodiments, addition of glycosylation sites to an antibody can be accomplished by adding or substituting one or more serine or threonine residues of an antibody (for O-linked glycosylation sites). In some embodiments, a number of carbohydrate moieties on an antibody can be increased by chemical or enzymatic coupling of glycosides to the antibody. In some embodiments, carbohydrate moieties present on an antibody can be removed chemically or enzymatically. In some embodiments, one or more of non-proteinaceous polymers (e.g., polyethylene glycol, polypropylene glycol, or polyoxyalkylenes) can be covalently added to an antibody.

In some embodiments, antibodies described herein can be attached at their C-terminal end to all, or part, of an immunoglobulin heavy chain derived from any antibody isotype, e.g., IgG, IgA, IgE, IgD, or IgM, or any of the isotype sub-classes, e.g., IgG1, IgG2b, IgG2a, IgG3, or IgG4. In some embodiments, antibodies, or functional fragments thereof may be glycosylated. In some embodiments, glycosylation at a variable domain framework residue can alter the binding interaction of the antibody with antigen. In some embodiments, antibodies, or functional fragments thereof may be modified by adding polyethylene glycol (PEG). In some embodiments, addition of PEG can lead to one or more of improved circulation time, improved solubility, improved resistance to proteolysis, reduced antigenicity and immunogenicity, improved bioavailability, reduced toxicity, improved stability, and/or easier formulation. In some embodiments, antibodies, or functional fragments thereof can be conjugated to, or recombinantly engineered with, an affinity tag (e.g., a purification tag).

Pharmaceutical Compositions

Additional embodiments of the disclosure relate to pharmaceutical compositions comprising an anti-EPOR antibody and/or anti-CD131 antibody and/or anti-EPO antibody and/or EPO analog and/or engineered EPOs, or a pharmaceutically acceptable salt, solvate or hydrate thereof, and one or more pharmaceutically acceptable excipients or carriers. The compositions can optionally contain an additional therapeutic agent. In general, a pharmaceutical composition comprises a therapeutically effective amount of an anti-EPOR antibody and/or an anti-CD131 antibody and/or an anti-EPO antibody and/or an EPO analog and/or an engineered EPO, one or more pharmaceutically acceptable excipients or carriers and optionally a therapeutically effective amount of an additional therapeutic agent, and is formulated for administration to a subject for therapeutic use.

Pharmaceutical compositions generally can be prepared according to current good manufacturing practice (GMP), as recommended or required by, e.g., the Federal Food, Drug, and Cosmetic Act § 501(a)(2)(B) and the International Conference on Harmonisation Q7 Guideline.

Pharmaceutical compositions/formulations can be prepared in sterile forms. For example, pharmaceutical compositions/formulations for parenteral administration by injection or infusion generally are sterile. Sterile pharmaceutical compositions/formulations can be compounded or manufactured according to pharmaceutical-grade sterilization standards known to those of skill in the art, such as those disclosed in or required by the United States Pharmacopeia Chapters 797, 1072 and 1211, and 21 Code of Federal Regulations 211.

Pharmaceutically acceptable excipients and carriers can include pharmaceutically acceptable substances, materials and/or vehicles. Non-limiting examples of types of excipients can include liquid and solid fillers, diluents, binders, lubricants, glidants, surfactants, dispersing agents, disintegration agents, emulsifying agents, wetting agents, suspending agents, thickeners, solvents, isotonic agents, buffers, pH adjusters, absorption-delaying agents, stabilizers, antioxidants, preservatives, antimicrobial agents, antibacterial agents, antifungal agents, chelating agents, adjuvants, sweetening agents, flavoring agents, coloring agents, encapsulating materials, and coating materials. The use of such excipients in pharmaceutical formulations is known in the art. For example, conventional vehicles and carriers can include, but are not limited to, oils (e.g., vegetable oils such as olive oil and sesame oil), aqueous solvents {e.g., saline, buffered saline (e.g., phosphate-buffered saline [PBS]) and isotonic solutions (e.g., Ringer's solution)}, and organic solvents (e.g., dimethyl sulfoxide [DMSO] and alcohols [e.g., ethanol, glycerol and propylene glycol]). Except insofar as any conventional excipient or carrier is incompatible with an anti-EPOR antibody, an anti-CD131 antibody, an anti-EPO antibody, an EPO analog, or an engineered EPO, or a fragment thereof, the disclosure encompasses the use of conventional excipients and carriers in formulations containing an anti-EPOR antibody, an anti-CD131 antibody, an anti-EPO antibody, an EPO analog, an engineered EPO, or a fragment thereof. See, e.g., Remington: The Science and Practice of Pharmacy, 21st Ed., Lippincott Williams & Wilkins (Philadelphia, Pennsylvania) (2005); Handbook of Pharmaceutical Excipients, 5th Ed., Rowe et al., Eds., The Pharmaceutical Press and the American Pharmaceutical Association (2005); Handbook of Pharmaceutical Additives, 3rd Ed., Ash and Ash, Eds., Gower Publishing Co. (2007); and Pharmaceutical Pre-formulation and Formulation, Gibson, Ed., CRC Press (Boca Raton, Florida) (2004).

Appropriate formulation can depend on various factors, such as the route of administration chosen. Potential routes of administration of a pharmaceutical composition comprising an anti-EPOR antibody and/or an anti-CD131 antibody and/or an anti-EPO antibody and/or an EPO analog and/or engineered EPOs can include, but are not limited to, oral, parenteral (including intradermal, subcutaneous, intramuscular, intravascular, intravenous, intraarterial, intraperitoneal, intramedullary, intrathecal and topical), intracavitary, and topical (including dermal/epicutaneous, transdermal, mucosal, transmucosal, intranasal [e.g., by nasal spray or drop], intraocular [e.g., by eye drop], pulmonary [e.g., by oral or nasal inhalation], buccal, sublingual, rectal [e.g., by suppository], and vaginal [e.g., by suppository]). Topical formulations can be designed to produce a local or systemic therapeutic effect. In certain embodiments, an anti-EPOR antibody and/or an anti-CD131 antibody and/or an anti-EPO antibody and/or an EPO analog and/or engineered EPOs, or a fragment thereof can be administered parenterally (e.g., intravenously, subcutaneously, intramuscularly or intraperitoneally) by injection (e.g., as a bolus) or by infusion over a period of time.

Excipients and carriers that can be used to prepare parenteral formulations can include, but are not limited to, solvents (e.g., aqueous solvents such as water, saline, physiological saline, buffered saline [e.g., phosphate-buffered saline], balanced salt solutions [e.g., Ringer's BSS] and aqueous dextrose solutions), isotonic/iso-osmotic agents (e.g., salts [e.g., NaCl, KCl and CaCl$_2$] and sugars [e.g., sucrose]), buffering agents and pH adjusters (e.g., sodium dihydrogen phosphate [monobasic sodium phosphate]/disodium hydrogen phosphate [dibasic sodium phosphate], citric acid/sodium citrate and L-histidine/L-histidine HCl), and emulsifiers (e.g., non-ionic surfactants such as polysorbates [e.g., polysorbate 20 and 80] and poloxamers [e.g., poloxamer 188]). Protein formulations and delivery systems are discussed in, e.g., A. J. Banga, Therapeutic Peptides and Proteins: Formulation, Processing, and Delivery Systems, 3rd Ed., CRC Press (Boca Raton, Florida) (2015).

The excipients can optionally include one or more substances that increase protein stability, increase protein solubility, inhibit protein aggregation, or reduce solution viscosity, or any combination or all thereof. Examples of such substances can include, but are not limited to, hydrophilic amino acids (e.g., arginine and histidine), polyols (e.g., myo-inositol, mannitol and sorbitol), saccharides {e.g., glucose (including D-glucose [dextrose]), lactose, sucrose and trehalose}, osmolytes (e.g., trehalose, taurine, amino acids [e.g., glycine, sarcosine, alanine, proline, serine, β-alanine and γ-aminobutyric acid], and betaines [e.g., trimethylglycine and trimethylamine N-oxide]), and non-ionic surfactants {e.g., alkyl polyglycosides, ProTek® alkylsaccharides (e.g., a monosaccharide [e.g., glucose] or a disaccharide [e.g., maltose or sucrose] coupled to a long-chain fatty acid or a corresponding long-chain alcohol), and polypropylene glycol/polyethylene glycol block co-polymers (e.g., poloxamers [e.g., Pluronic™ F-68], and Genapol® PF-10 and variants thereof)}. Because such substances can increase protein solubility, these substances can be used to increase protein concentration in a formulation. Higher protein concentration in a formulation can be advantageous for subcutaneous administration, which has a limited volume of bolus administration (e.g., ≤about 1.5 mL). In addition, such substances can be used to stabilize proteins during the preparation, storage and reconstitution of lyophilized proteins.

For parenteral (e.g., intravenous, subcutaneous or intramuscular) administration, a sterile solution or suspension of an anti-EPOR antibody and/or an anti-CD131 antibody and/or an anti-EPO antibody and/or an EPO analog and/or an engineered EPO in an aqueous solvent containing one or more excipients can be prepared beforehand and can be provided in, e.g., a pre-filled syringe. Alternatively, an anti-EPOR antibody and/or an anti-CD131 antibody and/or an anti-EPO antibody and/or an EPO analog and/or an engineered EPO can be dissolved or suspended in an aqueous solvent that can optionally comprise one or more excipients prior to lyophilization (freeze-drying). Shortly prior to parenteral administration, the lyophilized anti-EPOR antibody and/or anti-CD131 antibody and/or anti-EPO antibody and/or EPO analog and/or engineered EPO stored in a suitable container (e.g., a vial) can be reconstituted with, e.g., sterile water that can optionally comprise one or more excipients. If the anti-EPOR antibody and/or anti-CD131 antibody and/or anti-EPO antibody and/or EPO analog and/or engineered EPO is to be administered by infusion (e.g., intravenously), the solution or suspension of the reconstituted anti-EPOR antibody and/or anti-CD131 antibody and/or anti-EPO antibody and/or EPO analog and/or engineered EPO can be added to and diluted in an infusion bag containing, e.g., sterile saline (e.g., about 0.9% NaCl).

Excipients that can enhance transmucosal penetration of smaller proteins include, but are not limited to, cyclodextrins, alky saccharides (e.g., alkyl glycosides and alkyl maltosides [e.g., tetradecylmaltoside]), and bile acids (e.g., cholic acid, glycocholic acid, taurocholic acid, deoxycholic acid, glycodeoxycholic acid, chenodeoxycholic acid and dehydrocholic acid).

Excipients that can enhance transepithelial or transdermal penetration of smaller proteins include, but are not limited to, chemical penetration enhancers (CPEs, including fatty acids [e.g., oleic acid]), cell-penetrating peptides {CPPs, including arginine-rich CPPs [e.g., polyarginines such as R$_6$-R$_{11}$ (e.g., R$_6$ and R$_9$) and TAT-related CPPs such as TAT(49-57)] and amphipathic CPPs [e.g., Pep-1 and penetratin]}, and skin-penetrating peptides (SPPs, such as the skin-penetrating and cell-entering [SPACE] peptide). Transdermal penetration of smaller proteins can be further enhanced by use of a physical enhancement technique, such as iontophoresis, cavitational or non-cavitational ultrasound, electroporation, thermal ablation, radio frequency, microdermabrasion, microneedles or jet injection. US 2007/0269379 provides an extensive list of CPEs. F. Milletti, *Drug Discov. Today*, 17:850-860 (2012) is a review of CPPs. R. Ruan et al., *Ther. Deliv.*, 7:89-100 (2016) discuss CPPs and SPPs for transdermal delivery of macromolecules, and M. Prausnitz and R. Langer, *Nat. Biotechnol.*, 26:1261-1268 (2008) discuss a variety of transdermal drug-delivery methods.

An anti-EPOR antibody and/or an anti-CD131 antibody and/or an anti-EPO antibody and/or an EPO analog and/or an engineered EPO can be delivered from a sustained-release composition. As used herein, the term "sustained-release composition" can encompass sustained-release, prolonged-release, extended-release, slow-release and controlled-release compositions, systems and devices. Protein delivery systems are discussed in, e.g., Banga (supra). A sustained-release composition can deliver a therapeutically effective amount of an anti-EPOR antibody and/or an anti-CD131 antibody and/or an anti-EPO antibody and/or an EPO analog and/or an engineered EPO over a prolonged time period. In some embodiments, a sustained-release composition can deliver an anti-EPOR antibody and/or an anti-CD131 antibody and/or an anti-EPO antibody and/or EPO analog and/or an engineered EPO over a period of at least about 3 days, 1 week, 2 weeks, 3 weeks, 1 month (4 weeks), 6 weeks, 2 months, 3 months or longer. A sustained-release composition can be administered, e.g., parenterally (e.g., intravenously, subcutaneously or intramuscularly).

A sustained-release composition of an anti-EPOR antibody and/or an anti-CD131 antibody and/or an anti-EPO antibody and/or an EPO analog and/or an engineered EPO can be in the form of, e.g., a particulate system, a lipid or oily composition, or an implant. Particulate systems can include, but are not limited to, nanoparticles, nanospheres, nanocapsules, microparticles, microspheres, and microcapsules. Nanoparticulate systems generally can have a diameter or an equivalent dimension smaller than about 1 m. In certain embodiments, a nanoparticle, a nanosphere or a nanocapsule can have a diameter or an equivalent dimension of no more than about 500 nm, about 400 nm, or about 300 nm, or no more than about 200 nm, about 150 nm, or about 100 nm. In an aspect, a microparticle, a microsphere or a microcapsule can have a diameter or an equivalent dimension of about 1-200 µm, about 100-200 µm, or about 50-150 µm, or about 1-100 µm, about 1-50 µm, or about 50-100 µm. A nano- or a microcapsule can typically comprise a therapeutic agent in the central core, while the therapeutic agent typically can be dispersed throughout a nano- or a microparticle, or a sphere. In an aspect, a nanoparticulate system can be administered intravenously, while a microparticulate system can be administered subcutaneously or intramuscularly.

In an aspect, a sustained-release particulate system or implant can be made of a biodegradable polymer and/or a hydrogel. In certain embodiments, the biodegradable polymer can comprise lactic acid and/or glycolic acid [e.g., an L-lactic acid-based copolymer, such as poly(L-lactide-co-glycolide) or poly(L-lactic acid-co-D,L-2-hydroxyoctanoic acid)]. Non-limiting examples of polymers of which a hydrogel can be composed can include polyvinyl alcohol, acrylate polymers (e.g., sodium polyacrylate), and other homopolymers and copolymers having a relatively large number of hydrophilic groups (e.g., hydroxyl or/and carboxylate groups). The biodegradable polymer of the particulate system or implant can be selected so that the polymer substantially completely degrades around the time the period of treatment is expected to end, and so that the byproducts of the polymer's degradation, like the polymer, are biocompatible.

Alternatively, a sustained-release composition of a protein can be composed of a non-biodegradable polymer. Non-limiting examples of non-biodegradable polymers can include poloxamers (e.g., poloxamer 407). Sustained-release compositions of a protein can be composed of other natural or synthetic substances or materials, such as hydroxyapatite.

Sustained-release lipid or oily compositions of a protein can be in the form of, e.g., liposomes, micelles (e.g., those composed of biodegradable natural or/and synthetic polymers, such as lactosomes), or emulsions in an oil.

A sustained-release composition can be formulated or designed as a depot, which can be injected or implanted, e.g., subcutaneously or intramuscularly. A depot can be in the form of, e.g., a polymeric particulate system, a polymeric implant, or a lipid or oily composition. A depot formulation can comprise a mixture of a protein and, e.g., a biodegradable polymer [e.g., poly(lactide-co-glycolide)] or a semi-biodegradable polymer (e.g., a block copolymer of lactic acid and PEG) in a biocompatible solvent system, whether or not such a mixture forms a particulate system or implant.

A pharmaceutical composition can be presented in unit dosage form as a single dose wherein all active and inactive ingredients are combined in a suitable system, and components do not need to be mixed to form the composition to be administered. The unit dosage form can generally comprise an effective dose of the therapeutic agent. A representative example of a unit dosage form is a single-use pen comprising a pre-filled syringe, a needle and a needle cover for parenteral (e.g., intravenous, subcutaneous or intramuscular) injection of the therapeutic agent.

Alternatively, a pharmaceutical composition can be presented as a kit in which the therapeutic agent, excipients and carriers (e.g., solvents) are provided in two or more separate containers (e.g., ampules, vials, tubes, bottles or syringes) and need to be combined to form the composition to be administered. The kit can comprise instructions for storing, preparing and administering the composition (e.g., a solution to be injected intravenously or subcutaneously).

A kit can comprise all active and inactive ingredients in unit dosage form or the active ingredient and inactive ingredients in two or more separate containers, and can contain instructions for administering or using the pharmaceutical composition to treat a medical condition.

RNA, RNAi, small molecules and other agents described herein can be formulated as nanoparticles. A nanoparticle can have a mean diameter of about 50-200 nm. The nanoparticle can be a lipid nanoparticle. A lipid nanoparticle can comprise a cationic lipid, a neutral lipid, a PEG-modified lipid, a sterol, or a non-cationic lipid. In some embodiments, the lipid nanoparticle can comprise a molar ratio of about 20-60% cationic lipid, about 0.5-15% PEG-modified lipid, about 25-55% sterol, and about 25% non-cationic lipid. The cationic lipid can be an ionizable cationic lipid and the non-cationic lipid can be a neutral lipid, and/or the sterol can be a cholesterol. The cationic lipid can be selected from 2,2-dilinoleyl-4-dimethylaminoethyl-[1,3]-dioxolane (DLin-KC2-DMA), dilinoleyl-methyl-4-dimethylaminobutyrate (DLin-MC3-DMA), and di((Z)-non-2-en-1-yl) 9-((4-(dimethylamino)butanoyl)oxy)heptadecanedioate (L319).

A lipid nanoparticle formulation can be composed of a lipid mixture in molar ratios of about 20-70% cationic lipid:about 5-45% neutral lipid:about 20-55% cholesterol; and/or about 0.5-15% PEG-modified lipid. In some embodiments, a lipid nanoparticle formulation can be composed of a lipid mixture in a molar ratio of about 20-60% cationic lipid:about 5-25% neutral lipid:about 25-55% cholesterol; and/or about 0.5-15% PEG-modified lipid. In some embodiments, a lipid nanoparticle formulation can be composed of about 35 to 45% cationic lipid, about 40% to 50% cationic lipid, about 50% to 60% cationic lipid, and/or about 55% to 65% cationic lipid. In some embodiments, the ratio of lipid to RNA (e.g., mRNA) in lipid nanoparticles can be about 5:1 to about 20:1, about 10:1 to about 25:1, about 15:1 to about 30:1, and/or at least about 30:1.

A lipid nanoparticle formulation can include about 0.5% to about 15% on a molar basis of the neutral lipid, e.g., about 3 to 12%, about 5 to 10% or about 15%, about 10%, or about 7.5% on a molar basis. Examples of neutral lipids can include, but are not limited to, DSPC, POPC, DPPC, DOPE and SM.

The formulation can include from about 5% to about 50% on a molar basis of the sterol (e.g., about 15 to 45%, about 20 to 40%, about 40%, about 38.5%, about 35%, or about 31% on a molar basis. A non-limiting example of a sterol can include cholesterol.

A lipid nanoparticle formulation can include from about 0.5% to about 20% on a molar basis of the PEG or PEG-modified lipid (e.g., about 0.5 to 10%, about 0.5 to 5%, about 1.5%, about 0.5%, about 1.5%, about 3.5%, or about 5% on a molar basis. A PEG or PEG modified lipid comprises a PEG molecule of an average molecular weight of about 2,000 Da. A PEG or PEG modified lipid can comprise a PEG molecule of an average molecular weight of less than about 2,000 Da, for example about 1,500 Da, about 1,000 Da, or about 500 Da. Non-limiting examples of PEG-modified lipids can include PEG-distearoyl glycerol (PEG-DMG) (also referred herein as PEG-C14 or C14-PEG), and PEG-cDMA (further discussed in Reyes et al. J. Controlled Release, 107, 276-287 (2005) the contents of which are herein incorporated by reference in their entirety).

The ratio of PEG in the lipid nanoparticle formulations may be increased or decreased and/or the carbon chain length of the PEG lipid may be modified from C14 to C18 to alter the pharmacokinetics and/or biodistribution of the lipid nanoparticle formulations. As a non-limiting example, lipid nanoparticle formulations may contain from about 0.5% to about 3.0%, from about 1.0% to about 3.5%, from about 1.5% to about 4.0%, from about 2.0% to about 4.5%, from about 2.5% to about 5.0% and/or from about 3.0% to about 6.0% of the lipid molar ratio of PEG-c-DOMG (R-3-[(.omega.-methoxy-poly(ethyleneglycol)2000)carbamoyl)]-1,2-dimyristy-loxypropyl-3-amine) (also referred to herein as PEG-DOMG) as compared to the cationic lipid, DSPC and cholesterol. The PEG-c-DOMG may be replaced with a PEG lipid including, but not limited to, PEG-DSG (1,2-Distearoyl-sn-glycerol, methoxypolyethylene glycol), PEG-DMG (1,2-Dimyristoyl-sn-glycerol) and/or PEG-DPG (1,2-Dipalmitoyl-sn-glycerol, methoxypolyethylene glycol). The cationic lipid may be selected from any lipid known in the art including, but not limited to, DLin-MC3-DMA, DLin-DMA, C12-200 and DLin-KC2-DMA.

The molar lipid ratio can be 50/10/38.5/1.5 (mol % cationic lipid/neutral lipid, e.g., DSPC/Chol/PEG-modified lipid, e.g., PEG-DMG, PEG-DSG or PEG-DPG), 57.2/ 7.1134.3/1.4 (mol % cationic lipid/neutral lipid, e.g., DPPC/ Chol/PEG-modified lipid, e.g., PEG-cDMA), 40/15/40/5

(mol % cationic lipid/neutral lipid, e.g., DSPC/Chol/PEG-modified lipid, e.g., PEG-DMG), 50/10/35/4.5/0.5 (mol % cationic lipid/neutral lipid, e.g., DSPC/Chol/PEG-modified lipid, e.g., PEG-DSG), 50/10/35/5 (cationic lipid/neutral lipid, e.g., DSPC/Chol/PEG-modified lipid, e.g., PEG-DMG), 40/10/40/10 (mol % cationic lipid/neutral lipid, e.g., DSPC/Chol/PEG-modified lipid, e.g., PEG-DMG or PEG-cDMA), 35/15/40/10 (mol % cationic lipid/neutral lipid, e.g., DSPC/Chol/PEG-modified lipid, e.g., PEG-DMG or PEG-cDMA) or 52/13/30/5 (mol % cationic lipid/neutral lipid, e.g., DSPC/Chol/PEG-modified lipid, e.g., PEG-DMG or PEG-cDMA).

The amino alcohol cationic lipid may be the lipids described in and/or made by the methods described in U.S. Patent Publication No. US20130150625, which is incorporated by reference in its entirety for all purposes. As a non-limiting example, the cationic lipid may be 2-amino-3-[(9Z,12Z)-octadeca-9,12-dien-1-yloxy]-2-{[(9Z,2Z)-octa-deca-9,12- -dien-1-yloxy]methyl}propan-1-ol (Compound 1 in US20130150625); 2-amino-3-[(9Z)-octadec-9-en-1-yloxy]-2-{[(9Z)-octadec-9-en-1-yloxy]methy-1}propan-1-ol (Compound 2 in US20130150625); 2-amino-3-[(9Z, 12Z)-octadeca-9,12-dien-1-yloxy]-2-[(octyloxy)methyl] propa- n-1-ol (Compound 3 in US20130150625); and 2-(dimethylamino)-3-[(9Z,12Z)-octadeca-9,12-dien-1-yloxy]-2-{[(9Z,12Z)-octadeca-9,12-dien-1-yloxy] methyl}propan-1-ol (Compound 4 in US20130150625); or any pharmaceutically acceptable salt or stereoisomer thereof.

A lipid nanoparticle formulation can be composed of (i) at least one lipid selected from the group consisting of 2,2-dilinoleyl-4-dimethylaminoethyl-[1,3]-dioxolane (DLin-KC2-DMA), dilinoleyl-methyl-4-dimethylaminobutyrate (DLin-MC3-DMA), and di((Z)-non-2-en-1-yl) 9-((4-(dim-ethylamino)butanoyl)oxy)heptadecanedioate (L319); (ii) a neutral lipid selected from DSPC, DPPC, POPC, DOPE and SM; (iii) a sterol, e.g., cholesterol; and (iv) a PEG-lipid, e.g., PEG-DMG or PEG-cDMA, in a molar ratio of 20-60% cationic lipid:5-25% neutral lipid:25-55% sterol; 0.5-15% PEG-lipid.

Examples of lipid nanoparticle compositions and methods of making them are described, for example, in Cifuentes-Rius et al., (2021) Nature Nanotechnol. 16:37-46; Hou et al., (2021) Nature Rev. 6:1078-1094; Jang et al., (2021) Int. J. Med. Sci. 22:10009 (doi.org/10.3390/ijms221810009); Semple et al. (2010) Nat. Biotechnol. 28:172-176; Jayarama et al. (2012), Angew. Chem. Int. Ed., 51: 8529-8533; and Maier et al. (2013) Molecular Therapy 21, 1570-1578 (each of which are incorporated by reference in their entirety for all purposes).

A lipid nanoparticle formulation can be influenced by the selection of the cationic lipid component, the degree of cationic lipid saturation, the nature of the PEGylation, ratio of all components and biophysical parameters such as size. For example, in Semple et al. (Nature Biotech. 2010 28:172-176), the lipid nanoparticle formulation is composed of 57.1% cationic lipid, 7.1% dipalmitoylphosphatidylcholine, 34.3% cholesterol, and 1.4% PEG-c-DMA. As another example, changing the composition of the cationic lipid can more effectively deliver siRNA to various antigen presenting cells (Basha et al. Mol Ther. 2011 19:2186-2200, which is incorporated by reference in its entirety for all purposes).

A kit can contain an anti-EPOR and/or an anti-CD131 antibody and/or an anti-EPO antibody and/or an EPO analog and/or an engineered EPO or a pharmaceutical composition comprising the same, and instructions for administering or using the anti-EPOR antibody and/or anti-CD131 antibody and/or anti-EPO antibody and/or EPO analog and/or engineered EPO, or the pharmaceutical composition comprising the same to treat an antibody-associated condition.

In some aspects, provided herein is a cell comprising an anti-EPO antibody, an anti-EPOR antibody, an anti-CD131 antibody, an EPO analog, or an engineered EPO. In some embodiments, a cell can comprise an immune cell. Examples of an immune cell can include, but are not limited to, a macrophage, a dendritic cell, a T-cell, a natural killer cell, or a B cell. In some embodiments, a T-cell can comprise a cytotoxic T-cell. In some embodiments, a cell can comprise a myeloid cell. In some embodiments, a myeloid cell can comprise a granulocyte, a monocyte, a macrophage, or a dendritic cell. In some embodiments, a cell is an erythroid progenitor cell. In some embodiments, a cell can comprise an endothelial cell.

Uses of Anti-EPOR Antibodies, Anti-CD131 Antibodies, Anti-EPO Antibodies, and/or EPO Analous/Engineered EPOs In one aspect, EPO analogs or engineered EPOs that are antagonists for the hetero-EPOR, anti-hetero-EPOR antibodies that are antagonists for the hetero-EPOR, and/or anti-EPO antibodies that inhibit binding to the hetero-EPOR, and/or knocking down EPOR using siRNA targeting EPOR can be used to overcome immunosuppressive or tolerogenic states in a subject. For example, these EPO analogs, engineered EPOs, anti-hetero-EPOR antibodies, and/or anti-EPO antibodies, and/or knocking down EPOR using siRNA targeting EPOR can be used to overcome a tumor immune suppressive microenvironment, to boost immune response to vaccines, to enhance the immune response during an acute inflammatory response to disease (e.g., an infection from a microorganism or a virus), and/or to treat chronic infectious diseases or conditions. In some embodiments, EPO analogs, anti-hetero-EPOR antibodies, anti-CD131 antibodies and/or anti-EPO antibodies that are antagonists for the hetero-EPOR can inhibit immune tolerance. In some embodiments, inhibiting immune tolerance can comprise promoting or increasing immune response. For example, inhibiting immune tolerance can comprise increasing immune response to a vaccine, a viral infection, a bacterial infection, or a tumor antigen (e.g., an antigen produced by cancer).

In some embodiments, EPO analogs, anti-hetero-EPOR antibodies, anti-CD131 antibodies and/or anti-EPO antibodies that are antagonists for the hetero-EPOR can promote differentiation of naïve T cells into effector T cells. Markers for effector T cells described herein can include, but are not limited to, Cluster of Differentiation 45 (CD45), CD3, CD8, Perforin, Interferon gamma (IFNγ), Granzyme B, or tumor necrosis factor alpha (TNFα). In some embodiments, EPO analogs, anti-hetero-EPOR antibodies, anti-CD131 antibodies and/or anti-EPO antibodies that are antagonists for the hetero-EPOR can inhibit differentiation of naïve T cells into regulatory T cells. Markers for regulatory T cells described herein can include, but are not limited to, Cluster of Differentiation 4 (CD4), CD25, CD127, Forkhead Box P3 (FoxP3), CD39, protein tyrosine phosphatase receptor type C (CD45RA), Interleukin-2 (IL-2), or a Cytotoxic T-Lymphocyte Associated Protein 4 (CTLA-4). In some embodiments, EPO analogs, anti-hetero-EPOR antibodies, anti-CD131 antibodies and/or anti-EPO antibodies that are antagonists for the hetero-EPOR can increase a number of progenitor exhausted T cells. Markers for progenitor exhausted T cells can include, but are not limited to, Cluster of Differentiation 44 (CD44), Signaling lymphocyte activation molecule family member 6 (SLAMF6) or T cell factor 1 (TCF1).

In some embodiments, EPO analogs, anti-hetero-EPOR antibodies, anti-CD131 antibodies and/or anti-EPO antibodies that are antagonists for the hetero-EPOR can stimulate immune response in cancer. For example, EPO analogs, anti-hetero-EPOR antibodies, anti-CD131 antibodies and/or anti-EPO antibodies that are antagonists for the hetero-EPOR can render cancer cells sensitive to an immune checkpoint inhibitor. Examples of immune checkpoint inhibitors can include, but are not limited, to PD-1 inhibitors, PD-L1 inhibitors, and/or CTLA-4 inhibitors. In some embodiments, immune checkpoint inhibitors can comprise anti-CTLA-4 antibodies, anti-PD-1 antibodies, anti-PD-L1 antibodies, or functional fragments thereof, or combinations thereof. In some embodiments, immune checkpoint inhibitors can comprise Nivolumab, Pembrolizumab, Cemiplimab, Atezolimumab, Durvalumab, Avelumab, or Ipilimumab. In some embodiments, EPO analogs, anti-hetero-EPOR antibodies, anti-CD131 antibodies and/or anti-EPO antibodies that are antagonists for the hetero-EPOR can attenuate tumor growth. In some embodiments, EPO analogs, anti-hetero-EPOR antibodies, anti-CD131 antibodies and/or anti-EPO antibodies that are antagonists for the hetero-EPOR can reduce the size of a cancer or attenuate the growth of a cancer.

Tumors are frequently infiltrated with myeloid cells with immune tolerogenic or suppressive functions. Examples of myeloid cells include, but are not limited to, granulocytes, monocytes, macrophages (MΦs), or dendritic cells (DCs). The hetero-EPOR is widely present and upregulated in such tumor-infiltrating myeloid cells including both dendritic cells (DCs) and macrophages (MΦs), and contributes to immune tolerance or suppression. An antagonistic anti-hetero-EPOR antibody, and/or anti-EPO antibody that inhibits binding to the hetero-EPOR, and/or EPO analog/engineered EPO that are antagonists for the hetero-EPOR can block the activation of the hetero-EPOR (e.g., on myeloid cells) and can prevent immune suppression and antigen-specific immune tolerance thereby enabling effective anti-tumor immunity. In some embodiments, the antibody and/or EPO analog/engineered EPO may not bind the homo-EPOR and so will not interfere with erythropoiesis. The binding epitope of such anti-EPO antibody can be in helix B of the EPO. The ability of such blocking antibodies to reverse hetero-EPOR mediated immune tolerance can be validated in a variety of cancer models, e.g., liver hepatocarcinoma, colorectal cancer, breast cancer, brain cancer, liver metastasis, and lymph node metastasis etc. In addition to cancers, in some embodiments, EPO analogs, anti-hetero-EPOR antibodies, anti-CD131 antibodies and/or anti-EPO antibodies that are antagonists for the hetero-EPOR can be used to treat chronic infections. For example, chronic viral infections (e.g., Hepatitis B Virus, Herpes Simplex Virus, Human Papilloma Virus, Covid-19, influenza, Human Immunodeficiency Virus, meningitis, pneumonia, rotavirus, chicken pox, etc.) and/or chronic bacterial infections (e.g., Mycobacterium tuberculosis, fungal, anthrax, tetanus, leptospirosis, cholera, botulism, pseudomonas, pneumonia, E. coli, gonorrhea, bubonic plague, syphilis, methicillin-resistant Staphylococcus aureus, meningitis, etc.) can be treated similarly. These antibodies and/or analogs/engineered proteins can also be used to reduce an immune tolerogenic and/or immunosuppressive state for T-cells (e.g., cytotoxic T-cells, CAR T-cells, or TCR engineered T-cells) or natural killer cells (e.g., NK cells engineered with CARs or T-cell receptors).

Neoplasia, tumors and cancers that can be treated with the analogs/engineered proteins and antibodies described herein can include, for example, benign, malignant, metastatic and non-metastatic types, and can include any stage (I, II, Ill, IV or V) or grade (G1, G2, G3, etc.) of neoplasia, tumor, or cancer, or a neoplasia, tumor, cancer or metastasis that is progressing, worsening, stabilized or in remission. Cancers that may be treated according to the invention can include, but are not limited to, cells or neoplasms of the bladder, blood, bone, bone marrow, brain, breast, colon, esophagus, gastrointestines, gum, head, kidney, liver, lung, nasopharynx, neck, ovary, prostate, skin, stomach, testis, tongue, or uterus. In addition, the cancer may specifically be of the following histological type, though it is not limited to the following: neoplasm, malignant; carcinoma; undifferentiated; giant and spindle cell carcinoma; small cell carcinoma; papillary carcinoma; squamous cell carcinoma; lymphoepithelial carcinoma; basal cell carcinoma; pilomatrix carcinoma; transitional cell carcinoma; papillary transitional cell carcinoma; adenocarcinoma; gastrinoma, malignant; cholangiocarcinoma; hepatocellular carcinoma; combined hepatocellular carcinoma and cholangiocarcinoma; trabecular adenocarcinoma; adenoid cystic carcinoma; adenocarcinoma in adenomatous polyp; adenocarcinoma, familial polyposis coli; solid carcinoma; carcinoid tumor, malignant; bronchiolo-alveolar adenocarcinoma; papillary adenocarcinoma; chromophobe carcinoma; acidophil carcinoma; oxyphilic adenocarcinoma; basophil carcinoma; clear cell adenocarcinoma; granular cell carcinoma; follicular adenocarcinoma; papillary and follicular adenocarcinoma; nonencapsulating sclerosing carcinoma; adrenal cortical carcinoma; endometroid carcinoma; skin appendage carcinoma; apocrine adenocarcinoma; sebaceous adenocarcinoma; ceruminous adenocarcinoma; mucoepidermoid carcinoma; cystadenocarcinoma; papillary cystadenocarcinoma; papillary serous cystadenocarcinoma; mucinous cystadenocarcinoma; mucinous adenocarcinoma; signet ring cell carcinoma; infiltrating duct carcinoma; medullary carcinoma; lobular carcinoma; inflammatory carcinoma; Paget's disease, mammary; acinar cell carcinoma; adenosquamous carcinoma; adenocarcinoma with squamous metaplasia; thymoma, malignant; ovarian stromal tumor, malignant; theccoma, malignant; granulosa cell tumor, malignant; androblastoma, malignant; Sertoli cell carcinoma; Leydig cell tumor, malignant; lipid cell tumor, malignant; paraganglioma, malignant; extra-mammary paraganglioma, malignant; pheochromocytoma; glomangiosarcoma; malignant melanoma; amelanotic melanoma; superficial spreading melanoma; malignant melanoma in giant pigmented nevus; epithelioid cell melanoma; blue nevus, malignant; sarcoma; fibrosarcoma; fibrous histiocytoma, malignant; myxosarcoma; liposarcoma; leiomyosarcoma; rhabdomyosarcoma; embryonal rhabdomyosarcoma; alveolar rhabdomyosarcoma; stromal sarcoma; mixed tumor; Mullerian mixed tumor; nephroblastoma; hepatoblastoma; carcinosarcoma; mesenchymoma, malignant; Brenner tumor, malignant; phyllodes tumor, malignant; synovial sarcoma; mesothelioma, malignant; dysgerminoma; embryonal carcinoma; teratoma, malignant; struma ovarii, malignant; choriocarcinoma; mesonephroma, malignant; hemangiosarcoma; hemangioendothelioma, malignant; Kaposi's sarcoma; hemangiopericytoma, malignant; lymphangiosarcoma; osteosarcoma; juxtacortical osteosarcoma; chondrosarcoma; chondroblastoma, malignant; mesenchymal chondrosarcoma; giant cell tumor of bone; Ewing's sarcoma; odontogenic tumor, malignant; ameloblastic odontosarcoma; ameloblastoma, malignant; ameloblastic fibrosarcoma; pinealoma, malignant; chordoma; glioma, malignant; ependymoma; astrocytoma; protoplasmic astrocytoma; fibrillary astrocytoma; astroblastoma; glioblastoma; oligodendroglioma; oligodendroblastoma; primitive neuroectodermal; cerebellar sarcoma; ganglioneuroblastoma; neuroblastoma; retinoblastoma; olfactory neurogenic tumor; meningioma, malignant; neurofibrosarcoma; neurilemmoma, malignant; granular cell tumor, malignant; malignant lymphoma; Hodgkin's disease; Hodgkin's; paragranuloma; malignant lymphoma, small lymphocytic; malignant lymphoma, large cell, diffuse; malignant lymphoma, follicular; mycosis fungoides; other specified non-Hodgkin's lymphomas; malignant histiocytosis; multiple myeloma; mast cell sarcoma; immunoproliferative small intestinal disease; leukemia; lymphoid leukemia; plasma cell leukemia; erythroleukemia; lymphosarcoma cell leukemia; myeloid leukemia; basophilic leukemia; eosinophilic leukemia; monocytic leukemia; mast cell leukemia; megakaryoblastic leukemia; myeloid sarcoma; and hairy cell leukemia. In some embodiments, the neoplastic disease may be tumors associated with a cancer selected from prostate cancer, liver cancer, renal cancer, lung cancer, breast cancer, colorectal cancer, pancreatic cancer, brain cancer, hepatocellular cancer, lymphoma, leukemia, gastric cancer, cervical cancer, ovarian cancer, thyroid cancer, melanoma, head and neck cancer, skin cancer and soft tissue sarcoma and/or other forms of carcinoma. The tumor may be metastatic or a malignant tumor.

Effective vaccination can be challenging for a number of pathological conditions. Blocking hetero-EPOR signaling in the presence of specific antigen(s) can be effective at promoting antigen-specific immunity. This can be achieved by targeting hetero-EPOR expressing dendritic cells with the antigen and the above-mentioned antagonistic EPO analogs/engineered EPOs, antagonistic anti-hetero-EPOR antibodies, and/or anti-EPO antibodies that inhibit EPO from interacting with hetero-EPOR to enhance the immune response. It can also be achieved by nanoparticles that encapsulate mRNA of the antigen and an inhibitor of the hetero-EPOR signaling pathway which acts either on the heterodimeric receptor or its downstream intracellular signaling pathway. Exemplary vaccines can include vaccines for HIV, HCV, HSV, HBV, cancer vaccines, and/or virally caused diseases requiring repeated injections and/or immunity is short-lived, e.g., HBV, COVID, Influenza A, and/or Shingles.

In another aspect, EPO analogs or engineered EPOs that are agonists for the hetero-EPOR, and/or anti-EPOR antibodies that are agonists for the hetero-EPOR, and/or anti-CD131 antibodies that are agonists for the hetero-EPOR can be used to induce immunosuppressive or tolerogenic states in a subject. For example, these EPO analogs/engineered EPOs, anti-hetero-EPOR antibodies, and/or anti-EPO antibodies can be used to suppress transplant rejection, induce immune tolerance to specific antigens, reduce immune reaction in autoimmune diseases, reduce systemic chronic inflammation, and reduce damage to neural tissue and other tissue during injury or other stress.

In organ transplantation and bone marrow transplantation, immune tolerance, especially antigen-specific immune tolerance is desired, e.g., promoting survival of the transplanted organ, preventing Graft-versus-host disease (GvHD) and avoiding the use of highly toxic immunosuppressive drugs. An agonistic antibody for the hetero-EPOR or EPO analog/engineered EPO that is an agonist for the hetero- EPOR can promote immune tolerance. For example, anti-EPO antibodies, anti-hetero-EPOR antibodies, EPO analogs, engineered EPOs that can act as agonists for hetero-EPORs can promote immune tolerance in a subject that has been received an organ transplant or a foreign therapeutics protein. Examples of transplanted organ can comprise, but are not limited to, bone marrow, kidney, liver, lung, or heart. In some embodiments, agonistic antibody for the hetero-EPOR or EPO analog/engineered EPO that is an agonist for the hetero-EPOR may not bind the homo-EPOR. In some embodiments, agonistic antibody for the hetero-EPOR or EPO analog/engineered EPO that is an agonist for the hetero-EPOR may not affect a homo-EPO receptor activity. In some embodiments, agonistic antibody for the hetero-EPOR or EPO analog/engineered EPO that is an agonist for the hetero-EPOR may not affect erythropoiesis. The binding epitope of such an antibody can be the ligand-binding site on hetero-EPOR or the hetero-EPOR heterodimerization site.

Inducing antigen-specific immune tolerance can be beneficial in a number of conditions. It can be achieved by targeting dendritic cells and/or other antigen-presenting cells with the antigen and the agonists of the hetero-EPOR (EPO analogs or antibodies) to induce immune tolerance. It can also be achieved by nanoparticles that encapsulate mRNAs of the antigen and an agonist of the hetero-EPOR. Alternatively, the nanoparticles with the mRNA encoding the antigen can be combined with the agonist of the hetero-EPOR (together or separate administrations). Exemplary antigens for such immune tolerance applications can include, for example, recombinant therapeutic proteins (e.g., EndoS to reduce effector function driven autoimmunity, IgA degrading proteases (e.g., *H. influenzae, N. meningitidis*) for IgA nephropathy, Phenylalanine Hydroxylase for PKU, Uricase for chronic refractory gout), antigens responsible for autoimmune diseases, (e.g., T1D (insulin or pre/pro insulin), Pemphigus Vulgaris (Desmoglein-3), Primary Biliary Cirrhosis (PDC-E2), Graves' disease (TSHR), Myasthenia gravis (MuSK), Sjögren's syndrome (M3R), neuromyelitis optica (AQP4), IdeS (for IgG and complement driven autoimmune disease), Goodpasture syndrome (α3(IV)NC1), and hemophilia), and/or allergies induced by specific allergens (e.g., food, inhaled allergens, etc.).

Autoimmune diseases that can be treated with hetero-EPOR agonists can include, for example, systemic lupus erythematosus (SLE), inflammatory bowel disease (e.g., Crohn's disease and ulcerative colitis), rheumatoid arthritis, multiple sclerosis, Grave's disease, CREST syndrome, systemic sclerosis, celiac disease, Achalasia, Addison's disease, Adult Still's disease, Agammaglobulinemia, Alopecia areata, Amyloidosis, Ankylosing spondylitis, Anti-GBM/Anti-TBM nephritis, Antiphospholipid syndrome, Autoimmune angioedema, Autoimmune dysautonomia, Autoimmune encephalomyelitis, Autoimmune hepatitis, Autoimmune inner ear disease (AIED), Autoimmune myocarditis, Autoimmune oophoritis, Autoimmune orchitis, Autoimmune pancreatitis, Autoimmune retinopathy, Autoimmune urticaria, Axonal & neuronal neuropathy (AMAN), Baló disease, Behcet's disease, Benign mucosal pemphigoid, Bullous pemphigoid, Castleman disease (CD), Celiac disease, Chagas disease, Chronic inflammatory demyelinating polyneuropathy (CIDP), Chronic recurrent multifocal osteomyelitis (CRMO), Churg-Strauss Syndrome (CSS) or Eosinophilic Granulomatosis (EGPA), Cicatricial pemphigoid, Cogan's syndrome, Cold agglutinin disease, Congenital heart block, Coxsackie myocarditis, CREST syndrome, Crohn's disease, Dermatitis herpetiformis, Dermatomyositis, Devic's disease (neuromyelitis optica), Discoid lupus, Dressler's syndrome, Endometriosis, Eosinophilic esophagitis (EoE), Eosinophilic fasciitis, Erythema nodosum, Essential mixed cryoglobulinemia, Evans syndrome, Fibromyalgia, Fibrosing alveolitis, Giant cell arteritis (temporal arteritis), Giant cell myocarditis, Glomerulonephritis, Goodpasture's syndrome, Granulomatosis with Polyangiitis, Graves' disease, Guillain-Barre syndrome, Hashimoto's thyroiditis, Hemolytic anemia, Henoch-Schonlein purpura (HSP), Herpes gestationis or pemphigoid gestationis (PG), Hidradenitis Suppurativa (HS) (Acne Inversa), Hypogammalglobulinemia, IgA Nephropathy, IgG4-related sclerosing disease, Immune thrombocytopenic purpura (ITP), Inclusion body myositis (IBM), Interstitial cystitis (IC), Juvenile arthritis, Juvenile diabetes (Type 1 diabetes), Juvenile myositis (JM), Kawasaki disease, Lambert-Eaton syndrome, Leukocytoclastic vasculitis, Lichen planus, Lichen sclerosus, Ligneous conjunctivitis, Linear IgA disease (LAD), Lupus, Lyme disease chronic, Meniere's disease, Microscopic polyangiitis (MPA), Mixed connective tissue disease (MCTD), Mooren's ulcer, Mucha-Habermann disease, Multifocal Motor Neuropathy (MMN) or MMNCB, Multiple sclerosis, Myasthenia gravis, Myositis, Narcolepsy, Neonatal Lupus, Neuromyelitis optica, Neutropenia, Ocular cicatricial pemphigoid, Optic neuritis, Palindromic rheumatism (PR), PANDAS, Paraneoplastic cerebellar degeneration (PCD), Paroxysmal nocturnal hemoglobinuria (PNH), Parry Romberg syndrome, Pars planitis (peripheral uveitis), Parsonage-Turner syndrome, Pemphigus, Peripheral neuropathy, Perivenous encephalomyelitis, Pernicious anemia (PA), POEMS syndrome, Polyarteritis nodosa, Polyglandular syndromes type I, II, III, Polymyalgia rheumatica, Polymyositis, Postmyocardial infarction syndrome, Postpericardiotomy syndrome, Primary biliary cirrhosis, Primary sclerosing cholangitis, Progesterone dermatitis, Psoriasis, Psoriatic arthritis, Pure red cell aplasia (PRCA), Pyoderma gangrenosum, Raynaud's phenomenon, Reactive Arthritis, Reflex sympathetic dystrophy, Relapsing polychondritis, Restless legs syndrome (RLS), Retroperitoneal fibrosis, Rheumatic fever, Rheumatoid arthritis, Sarcoidosis, Schmidt syndrome, Scleritis, Scleroderma, Sjögren's syndrome, Sperm & testicular autoimmunity, Stiff person syndrome (SPS), Subacute bacterial endocarditis (SBE), Susac's syndrome, Sympathetic ophthalmia (SO), Takayasu's arteritis, Temporal arteritis/Giant cell arteritis, Thrombocytopenic purpura (TTP), Tolosa-Hunt syndrome (THS), Transverse myelitis, Type 1 diabetes, Type 2 diabetes, Ulcerative colitis (UC), Undifferentiated connective tissue disease (UCTD), Uveitis, Vasculitis, Vitiligo, and Vogt-Koyanagi-Harada Disease, etc. Other conditions that can be treated can include, for example, allergies (antibody associated allergies), amyloidosis, and certain forms of transplant rejection, etc. These and other conditions can be treated by administering one or more of the EPO analogs/engineered EPOs and/or antibodies described herein to a subject suffering from the undesired condition.

Activation of the hetero-EPOR with agonists for this receptor is beneficial in a number of neuronal and tissue stressed or injured conditions, e.g., Ischemia stroke, myocardial infarction, and Alzheimer's disease. Above-mentioned agonistic anti-hetero-EPOR, and/or EPO analogs/engineered EPOs that are agonists for the hetero-EPOR can be useful treatments in these conditions. Since EPO crosses the brain blood barrier (BBB), EPO analogs or engineered EPOs can be useful for CNS applications.

In some aspects, EPO analogs or engineered EPOs that are agonists for the homo-EPOR and do not bind or are antagonists of the hetero-EPOR, and/or anti-EPO antibodies that inhibit binding of EPO to the hetero-EPOR, and/or anti-hetero-EPOR antibodies that are antagonists for the hetero-EPOR can be used with or without erythropoietin-stimulating agents (ESA) for cancer patients in need to an ESA treatment. In this aspect, any cancer patient needing an ESA can be provided the ESA combined with these EPO analogs/engineered EPOs, and/or anti-EPOR antibodies, and/or anti-EPO antibodies.

In some embodiments, the use of ESAs in cancer patients can be limited because of the risk of thromboembolic events and accelerated disease progression and shortened survival. In this embodiment, immune tolerance and/or suppression mediated by activation of the hetero-EPOR on tumor infiltrated myeloid cells including both dendritic cells (DCs) and macrophages (MΦs) can be a major contributor to the enhanced tumor growth and shortened survival seen in cancer patients treated with ESA. In this embodiment, a non-immune tolerogenic or non-suppressive ESA can activate the homo-EPOR and not the hetero-EPOR and can be used to treat anemia in cancer patients without promoting immune tolerance or suppression. Since the interaction site between EPO and the hetero-EPOR resides in helix B of EPO, and helix B is not involved in binding to the homo-EPOR, EPO analogs or engineered EPOs with changes in helix B that inhibit binding to the hetero-EPOR may not interfere with binding to the homo-EPOR, resulting in analogs with the desired receptor activity profile for this use of ESAs in cancer patients. Alternatively, an anti-EPO antibody that neutralizes (or inhibits) binding to the hetero-EPOR while not interfering with EPO binding to the homo-EPOR can be combined with EPO (or other potential ESAs) to provide a combination that has the desired profile of activities at the hetero-EPOR and homo-EPOR for treatment of anemia in cancer patients.

In some embodiments, anti-EPO antibodies, anti-hetero-EPOR antibodies, EPO analogs, engineered EPOs described herein that can act as agonists for homo-EPOR may not affect immune tolerance. In some embodiments, anti-EPO antibodies, anti-hetero-EPOR antibodies, EPO analogs, engineered EPOs described herein that can act as agonists for homo-EPOR may not affect differentiation of naïve T cells into effector T cells. In some embodiments, markers of effector T cells can include Cluster of Differentiation 45 (CD45), CD3, CD8, Perforin, Interferon gamma (IFNγ), Granzyme B, or tumor necrosis factor alpha (TNFα). In some embodiments, anti-EPO antibodies, anti-hetero-EPOR antibodies, EPO analogs, engineered EPOs described herein that can act as agonists for homo-EPOR may not affect differentiation of a plurality of naïve T cells into a plurality of regulatory T cells. In some embodiments, markers for regulatory T cells can include Cluster of Differentiation 4 (CD4), CD25, CD127, Forkhead Box P3 (FoxP3), CD39, protein tyrosine phosphatase receptor type C (CD45RA), Interleukin-2 (TL-2), or a Cytotoxic T-Lymphocyte Associated Protein 4 (CTLA-4). In some embodiments, anti-EPO antibodies, anti-hetero-EPOR antibodies, EPO analogs, engineered EPOs described herein that can act as agonists for homo-EPOR may not affect immune response.

In some embodiments, anti-EPO antibodies, anti-hetero-EPOR antibodies, EPO analogs, engineered EPOs that can act as agonists for hetero-EPORs can induce antigen-specific immune tolerance. In some embodiments, anti-EPO antibodies, anti-hetero-EPOR antibodies, EPO analogs, engineered EPOs that can act as agonists for hetero-EPORs can inhibit differentiation of naïve T cells into effector T cells. Examples of markers for effector T cells can include, but are not limited to, Cluster of Differentiation 45 (CD45), CD3, CD8, Perforin, Interferon gamma (IFNγ), Granzyme B, or tumor necrosis factor alpha (TNFα). In some embodiments, anti-EPO antibodies, anti-hetero-EPOR antibodies, EPO analogs, engineered EPOs that can act as agonists for hetero-EPORs can promote differentiation of naïve T cells into regulatory T cells. Examples of markers for regulatory T cells can include, but are not limited to, Cluster of Differentiation 4 (CD4), CD25, CD127, Forkhead Box P3 (FoxP3), CD39, protein tyrosine phosphatase receptor type C (CD45RA), Interleukin-2 (TL-2), or a Cytotoxic T-Lymphocyte Associated Protein 4 (CTLA-4).

The therapeutically effective amount and the frequency of administration of, and the length of treatment with EPO analogs and/or engineered EPOs and/or anti-hetero-EPOR antibodies, and/or anti-EPO antibodies disclosed herein to treat an antibody-associated condition may depend on various factors, including the nature and severity of the condition, the potency of the antibody, the mode of administration, the age, body weight, general health, gender and diet of the subject, and the response of the subject to the treatment, and can be determined by the treating physician. The therapeutically effective amount of the antibody and/or analog can be from about 1, 5 or 10 mg to about 200 mg, from about 1, 5 or 10 mg to about 150 mg, from about 1, 5 or 10 mg to about 100 mg, or from about 1, 5 or 10 mg to about 50 mg, or as deemed appropriate by the treating physician, which can be administered in a single dose or in divided doses. The therapeutically effective amount of the antibody and/or analog can be about 1-5 mg, about 5-10 mg, about 10-20 mg, about 20-30 mg, about 30-40 mg, about 40-50 mg, about 50-100 mg, about 100-150 mg, or about 150-200 mg. The therapeutically effective amount of the antibody and/or analog can be about 1 mg, about 5 mg, about 10 mg, about 15 mg, about 20 mg, about 25 mg, about 30 mg, about 40 mg, about 50 mg, about 60 mg, about 70 mg, about 80 mg, about 90 mg, about 100 mg, about 150 mg, or about 200 mg. The therapeutically effective amount of the antibody and/or analog can be about 1-5 mg, about 5-10 mg, or about 10-50 mg. The therapeutically effective amount of the antibody and/or analog can be about 0.01-0.1 mg/kg, about 0.1-0.5 mg/kg, about 0.5-1 mg/kg, about 1-2 mg/kg, or about 2-3 mg/kg body weight, or as deemed appropriate by the treating physician. The therapeutically effective amount of the antibody and/or analog can be about 0.01-0.1 mg/kg, about 0.1-0.5 mg/kg, or about 0.5-1 mg/kg body weight.

In some aspects, an antibody and/or analog can be administered in any suitable frequency to treat a patient. The antibody or analog can be administered once daily, once every 2 days, once every 3 days, twice weekly, once weekly, once every 2 weeks, once every 3 weeks, once monthly, once every 6 weeks, once every 2 months, or once every 3 months, or as deemed appropriate by the treating physician. The antibody and/or analog can be administered once weekly or once every 2 weeks.

Likewise, an antibody and/or analog can be administered for any suitable length of time, or in any suitable total number of doses, to treat a patient. The antibody and/or analog is administered over a period of at least about 1 week, 2 weeks, 1 month (4 weeks), 6 weeks, 2 months, 3 months, 6 months, 1 year, 2 years, 3 years or longer, or as deemed appropriate by the treating physician. The condition treated can be a chronic condition. A chronic condition can exist for, e.g., at least about 6 weeks or 2 months or longer. The antibody and/or analog can be administered over a period of at least about 6 weeks, about 2 months, about 3 months, or about 6 months. In some embodiments, 1, 2, 3, 4, 5, or 6 doses of the antibody and/or analog can be administered for the entire treatment regimen. In some embodiments, 1, 2, or 3 doses of the antibody and/or analog can be administered for the entire treatment regimen.

In some aspects, an antibody and/or analog can also be administered in an irregular manner to treat a patient. For example, the antibody and/or analog can be administered 1, 2, 3, 4, 5, or more times in a period of 1 week, 2 weeks, 3 weeks, 1 month, 2 months, or 3 months in an irregular manner. Furthermore, an antibody and/or analog can be taken pro re nata (as needed) for treatment of a patient. For instance, the antibody and/or analog can be administered 1, 2, 3, 4, 5, or more times, whether in a regular or irregular manner, for treatment of a patient. The appropriate dosage of, frequency of dosing of and length of treatment with the antibody and/or analog can be determined by the treating physician.

For a more rapid establishment of a therapeutic level of an antibody or analog at least one loading dose of the antibody and/or analog can be administered prior to the maintenance dose. A loading dose can be administered, followed by (i) one or more additional loading doses and then one or more therapeutically effective maintenance doses, or (ii) one or more therapeutically effective maintenance doses without an additional loading dose, as deemed appropriate by the treating physician. A loading dose of an antibody and/or analog can be larger (e.g., about 1.5, 2, 3, 4, or 5 times larger) than a subsequent maintenance dose and is designed to establish a therapeutic level of the drug more quickly. The one or more therapeutically effective maintenance doses can be any therapeutically effective amount described herein. The loading dose can be about 2 or 3 times larger than the maintenance dose. A loading dose can be administered on day 1, and a maintenance dose can be administered, e.g., once weekly or once every 2 weeks thereafter for the duration of treatment. The antibody and/or analog can be administered in a loading dose of about 2-10 mg, about 10-20 mg, or about 20-100 mg, or about 3-15 mg, about 15-30 mg, or about 30-150 mg, on day 1, followed by a maintenance dose of about 1-5 mg, about 5-10 mg, or about 10-50 mg once weekly or once every 2 weeks for the duration of treatment (e.g., for at least about 2, 3, or 6 months), where the loading dose is about 2 or 3 times larger than the maintenance dose and the antibody or analog is administered parenterally (e.g., intravenously, subcutaneously or intramuscularly).

In some embodiments, two (or more) loading doses of the antibody and/or analog can be administered prior to the maintenance dose. A first loading dose of the antibody and/or analog can be administered on day 1, a second loading dose can be administered, e.g., about 1 or 2 weeks later, and a maintenance dose can be administered, e.g., once weekly or once every 2 weeks thereafter for the duration of treatment. The first loading dose can be about 3 or 4 times larger than the maintenance dose, and the second loading dose can be about 2 times larger than the maintenance dose. The antibody and/or analog can be administered in a first loading dose of about 3-15 mg, about 15-30 mg, or about 30-150 mg, or about 4-20 mg, about 20-40 mg, or about 40-200 mg, on day 1, in a second loading dose of about 2-10 mg, about 10-20 mg, or about 20-100 mg about 1 or 2 weeks later, followed by a maintenance dose of about 1-5 mg, about 5-10 mg, or about 10-50 mg once weekly or once every 2 weeks for the duration of treatment (e.g., for at least about 2, 3 or 6 months), where the first loading dose can be about 3 or 4 times larger than the maintenance dose, the second loading dose can be about 2 times larger than the maintenance dose, and the antibody or analog can be administered parenterally (e.g., intravenously, subcutaneously or intramuscularly).

Combination Therapies with Additional Therapeutic Agents

The disclosure provides a method of treating a patient, comprising administering to a subject in need of treatment a therapeutically effective amount of an antibody and/or analog described herein, optionally in combination with an additional therapeutic agent. The disclosure further provides an antibody and/or analog described herein, or a composition comprising an antibody and/or analog described herein, for use as a medicament, optionally in combination with an additional therapeutic agent. In addition, the disclosure provides for the use of an antibody and/or analog described herein in the preparation of a medicament, optionally in combination with an additional therapeutic agent.

One or more additional therapeutic agents can optionally be used in combination with an antibody or analog to treat a patient. The optional additional therapeutic agent(s) can be administered to a subject concurrently with (e.g., in the same composition as the antibody and/or analog or in separate compositions) or sequentially to (before or after) administration of the antibody and/or analog. The optional additional therapeutic agent(s) can be selected from anti-cancer agents, immunotherapy agents, immunosuppressive agents, anti-inflammatory agents, allergy drugs, and combinations thereof. One or more immunosuppressive agents can be used in combination with an antibody and/or analog to treat a patient.

Anti-cancer agents can include, for example, a chemotherapeutic, an antibody, an antibody-drug conjugate, an immunotherapy, a chimeric antigen receptor cell therapy, a radiotherapy, an alkylating agent, a plant alkaloid, an anti-tumor antibiotic, an antimetabolite, a topoisomerase inhibitor, and/or an anti-neoplastic.

Antibodies and antibody-drug conjugates (ADC) can bind to a tumor associated antigen. The drug component of the ADC can be, for example, a chemotherapeutic, a radionucleotide, an alkylating agent, a plant alkaloid, an antitumor antibiotic, an antimetabolite, a topoisomerase inhibitor, and/or an anti-neoplastic. The drug component of the ADC can be attached to the antibody through a linker which can be cleavable or non-cleavable in nature.

Alkylating agents can include, for example, mustard gas derivatives (e.g., mechlorethamine, cyclophosphamide, chlorambucil, melphalan, or ifosfamide), ethylenimines (e.g., thiotepa or hexamethylmelamine), alkylsulfonates (e.g., busulfan), hydrazines and triazines (e.g., altretamine, procarbazine, dacarbazine, or temozolomide), nitrosoureas (e.g., carmustine, lomustine or streptozocin), and metal salts (e.g., carboplatin, cisplatin, or oxaliplatin). Plant alkaloids can include, for example, *Vinca* alkaloids (e.g., vincristine, vinblastine, or vinorelbine), taxanes (e.g., paclitaxel or docetaxel), podophyllotoxins (e.g., etoposide or tenisopide), and camptothecan analogs (e.g., irinotecan or topotecan). Anti-tumor antibiotics can include, for example, anthracyclines (e.g., doxorubicin, daunorubicin, epirubicin, mixoantrone, or idarubicin), and chromomycins (e.g., dactinomycin or plicamycin). Antimetabolites can include, for example, folic acid antagonists (e.g., methotrexate), pyrimidine antagonists (e.g., 5-flurouracil, foxuridine, cytarabine, capecitabine, or gemcitabine), purine antagonists (e.g., 6-mercaptopurine or 6-thioguanine), and adenosine deaminase inhibitors (e.g., cladribine, fludarabine, nelarabine, or pentostatin). Topoisomerase inhibitors can include, for example, topoisomerase I inhibitors (e.g., irinotecan or topotecan) and topoisomerase II inhibitors (e.g., amsacrine, etoposide, etoposide phosphate, or teniposide). Anti-neoplastics can include, for example, ribonucleotide reductase inhibitors (e.g., hydroxyurea), adrenocortical steroid inhibitors (e.g., mitotane), enzymes (e.g., asparaginase or pegaspargase), antimicrotubule agents (e.g., estramustine), and retinoids (e.g., bexarotene, isotretinoin, or tretinoin).

Other chemotherapeutic drugs can include, for example, an anthracycline, a camptothecin, a tubulin inhibitor, a maytansinoid, a calicheamycin, a pyrrolobenzodiazepine dimer (PBD), an auristatin, a nitrogen mustard, an ethylenimine derivative, an alkyl sulfonate, a nitrosourea, a triazene, a folic acid analog, a taxane, a COX-2 inhibitor, a pyrimidine analog, a purine analog, an antibiotic, an enzyme inhibitor, an epipodophyllotoxin, a platinum coordination complex, a vnca alkaloid, a substituted urea, a methyl hydrazine derivative, an adrenocortical suppressant, a hormone antagonist, an antimetabolite, an alkylating agent, an antimitotic, an anti-angiogenic agent, a tyrosine kinase inhibitor, an mTOR inhibitor, a heat shock protein (HSP90) inhibitor, a proteosome inhibitor, an HDAC inhibitor, a pro-apoptotic agent, and a combination thereof.

Other chemotherapeutic agents can include, for example, 5-fluorouracil, afatinib, aplidin, azaribine, anastrozole, anthracyclines, axitinib, AVL-101, AVL-291, bendamustine, bleomycin, bortezomib, bosutinib, bryostatin-1, busulfan, calicheamycin, camptothecin, carboplatin, 10-hydroxycamptothecin, carmustine, celecoxib, chlorambucil, cisplatinum, COX-2 inhibitors, irinotecan (CPT-11), SN-38, carboplatin, cladribine, camptothecans, crizotinib, cyclophosphamide, cytarabine, dacarbazine, dasatinib, dinaciclib, docetaxel, dactinomycin, daunorubicin, DM1, DM3, DM4, doxorubicin, 2-pyrrolinodoxorubicine (2-PDox), a pro-drug form of 2-PDox (pro-2-PDox), cyanomorpholino doxorubicin, doxorubicin glucuronide, endostatin, epirubicin glucuronide, erlotinib, estramustine, epidophyllotoxin, erlotinib, entinostat, estrogen receptor binding agents, etoposide (VP16), etoposide glucuronide, etoposide phosphate, exemestane, fingolimod, floxuridine (FUdR), 3',5'-O-dioleoyl-FudR (FUdR-dO), fludarabine, flutamide, farnesyl-protein transferase inhibitors, flavopiridol, fostamatinib, ganetespib, GDC-0834, GS-1101, gefitinib, gemcitabine, hydroxyurea, ibrutinib, idarubicin, idelalisib, ifosfamide, imatinib, lapatinib, lenolidamide, leucovorin, LFM-A13, lomustine, mechlorethamine, melphalan, mercaptopurine, 6-mercaptopurine, methotrexate, mitoxantrone, mithramycin, mitomycin, mitotane, monomethylauristatin F (MMAF), monomethylauristatin D (MMAD), monomethylauristatin E (MMAE), navelbine, neratinib, nilotinib, nitrosurea, olaparib, plicomycin, procarbazine, paclitaxel, PCI-32765, pentostatin, PSI-341, raloxifene, semustine, SN-38, sorafenib, streptozocin, SU11248, sunitinib, tamoxifen, temazolomide, transplatinum, thalidomide, thioguanine, thiotepa, teniposide, topotecan, uracil mustard, vatalanib, vinorelbine, vinblastine, vincristine, *vinca* alkaloids and ZD1839. In some embodiments, the chemotherapeutic agents can be SN-38.

Immunotherapy is directed at boosting the body's natural defenses in order to fight a disease, a cancer or tumor. It capitalizes on the substances made by the body, or artificially in a laboratory, to improve or restore immune system function. Immunotherapies can include checkpoint inhibitors that target immune checkpoints such as CTLA-4 and PD-1/PD-L1, key regulators of the immune system that dampen the immune response. Immunotherapies can comprise anti-CTLA-4 antibody, an anti-PD-1 antibody, an anti-PD-L1 antibody, or any combinations thereof. Examples of checkpoint inhibitors that may be used as payloads can include, for example, Nivolumab (Opdivo®), Pembrolizumab (Keytruda®), Cemiplimab (Libtayo®), Atezolizumab (Tecentriq®), Avelumab (Bavencio®), Durvalumab (Imfinzi®), Ipilimumab (Yervoy®), Lirilumab, and BMS-986016 (Relatlimab). Nivolumab, Atezolizumab and Pembrolizumab can act at the checkpoint protein PD-1 and can inhibit apoptosis of anti-tumor immune cells. Some checkpoint inhibitors can prevent the interaction between PD-1 and its ligand PD-L1. Ipilimumab can act at CTLA4 and can prevent CTLA4 from downregulating activated T-cells in the tumor. Lirilumab can act at KIR and can facilitate activation of Natural Killer cells. BMS-986016 can act at LAG3 and can activate antigen-specific T-lymphocytes and can enhance cytotoxic T cell-mediated lysis of tumor cells. Other types of immunotherapies can include, for example, monoclonal antibodies, tumor-agnostic therapies, non-specific immunotherapies, oncolytic virus therapy, adoptive cell transfer, e.g., CAR T-cell therapy and cancer vaccines. Non-specific immunotherapies can include treatment with interferons or interleukins, molecules which can help the immune system fight cancer and either slow the growth of cancer cells or, in some instance, destroy the cancer. Immunotherapies may be given instead of traditional cancer treatments, such as chemotherapy or radiation therapy, or in combination with such treatments.

Adoptive cell therapy may use cells that have originated from the subject (autologous) or from another subject (allogeneic). Examples of such adoptive cell therapies can include, but are not limited to, engineered or non-engineered macrophages, engineered or non-engineered T-cells, and/or engineered or non-engineered natural killer cells. Accordingly, adoptive cell therapies can include tumor-Infiltrating Lymphocyte (TIL) therapy, Engineered T Cell Receptor (TCR) therapy, and/or natural killer (NK) cell therapy, the details of which will be well known to those skilled in the art (Adoptive cellular therapies: the current landscape, Rohaan et al. 2019, Virchows Arch. 474(4): 449-461, which is incorporated by reference in its entirety for all purposes).

Immunosuppressive agents can include, for example, anti-CD20 antibodies (e.g., rituximab), calcineurin inhibitors (e.g., tacrolimus, cyclosporine, etc.), antiproliferative agents or IDMH inhibitors (e.g., mycophenolate mofetil, mycophenolate sodium, azathioprine, leflunomide, etc.), mTOR inhibitors (e.g., Sirolimus, everolimus, etc.), steroids (e.g., corticosteroids such as prednisone, budesonide, prednisolone, etc.), and biologics (e.g., abatacept, adalimumab, anakinra, certolizumab, etanercept, infliximab, ixekizumab, natalizumab, rituximab, secukinumab, tocilizumab, uestekinumab, vedolizumab, basiliximab, daclizumab, muromonab). Biologics can also include, for example, CTLA 4 fusion proteins, anti-TNFα antibodies, IL-1 receptor antagonist protein, TNF receptor fusion proteins, anti-IL17A antibodies, anti-α4 integrin antibodies, anti-IL6 receptor antibodies, anti-p40 subunit of IL12/IL23 antibodies, anti-$\alpha_4\beta_7$ integrin antibodies, anti-CD25 antibodies, and anti-CD3 antibodies.

One or more anti-inflammatory agents can be used in combination with an antibody or analog to treat a patient. The one or more anti-inflammatory agents can include, for example, an inhibitor of a pro-inflammatory cytokine or a receptor therefor or the production thereof (e.g., TNF-α or/and IL-6 or IL-6R). Other anti-inflammatory agents can include, for example: non-steroidal anti-inflammatory drugs (NSAIDs), immunomodulators, immunosuppressants, anti-inflammatory cytokines and compounds that increase their production, inhibitors of pro-inflammatory cytokines or receptors therefor, inhibitors of the production of pro-inflammatory cytokines or receptors therefor, inhibitors of pro-inflammatory transcription factors or their activation or expression, inhibitors of pro-inflammatory prostaglandins (e.g., prostaglandin $E_2$ [$PGE_2$]) or receptors therefor (e.g., $EP_3$) or the production thereof, inhibitors of leukotrienes or receptors therefor or the production thereof, inhibitors of phospholipase A2 (e.g., secreted and cytosolic PLA2), suppressors of C-reactive protein (CRP) activity or level, mast cell stabilizers, phosphodiesterase inhibitors, specialized pro-resolving mediators (SPMs), other kinds of anti-inflammatory agents, and analogs, derivatives, fragments and salts thereof.

Non-steroidal anti-inflammatory drugs (NSAIDs) can include, but are not limited to, acetic acid derivatives, anthranilic acid derivatives (fenamates), enolic acid derivatives (oxicams), propionic acid derivatives, salicylates, COX-2-selective inhibitors, other kinds of NSAIDs, such as monoterpenoids (e.g., eucalyptol and phenols [e.g., carvacrol]), anilinopyridinecarboxylic acids (e.g., clonixin), sulfonanilides (e.g., nimesulide), and dual inhibitors of lipooxygenase (e.g., 5-LOX) and cyclooxygenase (e.g., COX-2) (e.g., chebulagic acid, licofelone, 2-(3,4,5-trimethoxyphenyl)-4-(N-methylindol-3-yl)thiophene, and di-tert-butylphenol-based compounds [e.g., DTPBHZ, DTPINH, DTPNHZ and DTPSAL]); and analogs, derivatives and salts thereof.

The glucocorticoid class of corticosteroids can have anti-inflammatory and immunosuppressive properties. Glucoconicoids can include, but are not limited to, hydrocortisone types, halogenated steroids, carbonates, and analogs, derivatives and salts thereof.

The optional additional therapeutic agent(s) independently can be administered in any suitable mode. Potential modes of administration can include, but are not limited to, oral, parenteral (including intradermal, subcutaneous, intramuscular, intravascular, intravenous, intraarterial, intraperitoneal, intramedullary, intrathecal and topical), intracavitary, and topical (including dermal/epicutaneous, transdermal, mucosal, transmucosal, intranasal [e.g., by nasal spray or drop], intraocular [e.g., by eye drop], pulmonary [e.g., by oral or nasal inhalation], buccal, sublingual, rectal [e.g., by suppository] and vaginal [e.g., by suppository]). In some embodiments, the optional additional therapeutic agent(s) independently can be administered orally or parenterally (e.g., intravenously, subcutaneously or intramuscularly).

One or more anti-allergy agents can be used in combination with an antibody or analog to treat a patient. Such anti-allergy agents can include, for example, antihistamines (e.g., cetirizine, fexofenadine, levocetirizine, loratidine, bormpheniramine, chlorpheniramine, celmastine, diphenhydramine, ketotifen, naphazoline, pheniramine, desloratadine, azelastine, epinastine, olopatadine), decongestants (e.g., pseudoephedrine, phenylephrine, oxymetazoline), steroids (e.g., beclomethasone, ciclesonide, fluticasone furoate, mometasone, budesonide, triamcinolone, dexamethasone, loteprednol, prednisone epocrates), mast cell stabilizers (e.g., cromolyn sodium, lodoxamide-tromethamine, nedocromil, pemirolast), and leukotriene modifiers (e.g., monteleukast).

One or more anti-rejection drugs for a transplant can be used in combination with an agonist anti-hetero-EPOR antibody and/or EPO analogs/engineered EPOs that are agonists for the hetero-EPOR to treat a subject following a transplant procedure. Such anti-rejection drugs can include, for example, calcineurin inhibitors, antiproliferative agents or IDMH inhibitors, mTOR inhibitors, and steroids.

The optional additional therapeutic agent(s) independently can be administered in any suitable frequency, including, but not limited to, daily (1, 2 or more times per day), every two or three days, twice weekly, once weekly, every two weeks, every three weeks, monthly, every two months or every three months, or in an irregular manner or on an as-needed basis. The dosing frequency can depend on, e.g., the mode of administration chosen. The length of treatment with the optional additional therapeutic agent(s) can be determined by the treating physician and can independently be, e.g., at least about 1 day, 2 days, 3 days, 4 days, 1 week, 2 weeks, 3 weeks, 4 weeks (1 month), 6 weeks, 2 months, 3 months, 6 months, 1 year, 2 years, 3 years or longer.

Production of EPO Related Antibodies

The disclosure provides polynucleotides comprising nucleic acid sequences that encode EPO related antibodies (e.g., anti-EPO antibodies, anti-EPOR antibodies, or anti-CD131 antibodies), and/or EPO analogs/engineered EPOs described herein. A polynucleotide can comprise a nucleic acid sequence that encodes an EPO analog, an engineered EPO, or the VH domain or/and the $V_L$ domain of an anti-EPOR, an anti-CD131, or an anti-EPO mAb. A polynucleotide can comprise a nucleic acid sequence that encodes the EPO analog, the engineered EPO, or heavy chain or/and the light chain of an EPO related mAb (e.g., anti-EPO antibodies, anti-EPOR antibodies, or anti-CD131 antibodies).

The disclosure further provides constructs (which may also be called expression or cloning constructs) comprising nucleic acid sequences that encode EPO related antibodies or EPO analogs described herein. Suitable constructs include, but are not limited to, plasmids, cosmids, bacterial artificial chromosomes, yeast artificial chromosomes, lambda phages (e.g., those with lysogeny genes deleted), and viruses. A construct can be present in a cell episomally or integrated into a chromosome (either way the construct remains and is still a construct, a plasmid and/or a vector).

Various construct systems can be employed. One class of constructs utilize DNA elements derived from animal viruses such as adenovirus, baculovirus, bovine papilloma virus, polyoma virus, SV40 virus, vaccinia virus, and retroviruses (e.g., MMTV, MOMLV and rous sarcoma virus). Another class of constructs utilize RNA elements derived from RNA viruses such as eastern equine encephalitis virus, flaviviruses, and Semliki Forest virus.

A construct can comprise various other elements for optimal expression of mRNA in addition to a nucleic acid sequence that encodes, e.g., the $V_H$ domain or/and the $V_L$ domain, or the heavy chain or/and the light chain, of an EPO related mAb, or EPO analog/engineered EPO. For example, a construct can contain a transcriptional promoter, a promoter plus an operator, an enhancer, an open reading frame with or without intron(s) or/and exon(s), a termination signal, a splice signal, a secretion signal sequence or a selectable marker (e.g., a gene conferring resistance to an antibiotic or cytotoxic agent), or any combination or all thereof.

The disclosure also provides host cells comprising or expressing constructs that encode EPO related antibodies or EPO analog/engineered EPO described herein. Suitable host cells include, but are not limited to, eukaryotic cells, mammalian cells (e.g., BHK, CHO, COS, HEK293, HeLa, MDCKII and Vero cells), insect cells (e.g., Sf9 cells), yeast cells and bacterial cells (e.g., E. coli cells). The host cell can be a mammalian cell (e.g., a CHO cell or a HEK293 cell).

A host cell can comprise or express a construct that encodes the $V_H$ domain or the $V_L$ domain, or the heavy chain or the light chain, of an EPO related mAb or EPO analog. A host cell can comprise or express a single construct that encodes the EPO analog, or the $V_H$ domain and the $V_L$ domain, or the heavy chain and the light chain, of an EPO related mAb. The same host cell or separate host cells can comprise or express a construct that encodes the VH domain or the heavy chain of an EPO related mAb, and a separate construct that encodes the $V_L$ domain or the light chain of the mAb.

A construct can be transfected or introduced into a host cell by any method known in the art. Transfection agents and methods include without limitation calcium phosphate, cationic polymers (e.g., DEAE-dextran and polyethylenimine), dendrimers, fugene, cationic liposomes, electroporation, sonoporation, cell squeezing, gene gun, viral transfection and retroviral transduction.

Methods and conditions for culturing transfected host cells and recovering the recombinantly produced EPO related antibody or EPO analog/engineered EPO are known in the art, and may be varied or optimized depending on, e.g., the particular expression vector or/and host cell employed. EPO analogs/engineered EPOs, or the $V_H$ domain or/and the $V_L$ domain, or the heavy chain or/and the light chain, of an EPO related mAb can be recombinantly produced. The heavy chain and the light chain of an EPO related antibody whole IgG1, IgG2 or IgG4, or the heavy chain and the light chain of an EPO related Fab fragment optionally fused with a protracting moiety, are recombinantly produced.

NUMBERED EMBODIMENTS

1. A method, comprising the steps of: administering an EPO analog to a patient, wherein the patient has a cancer, wherein the EPO analog is an antagonist for a hetero-EPOR; and binding the EPO analog to the hetero-EPOR thereby inhibiting the hetero-EPOR.
2. The method of embodiment 1, wherein the hetero-EPOR is on an immune cell.
3. The method of embodiment 2, wherein the immune cell is a macrophage.
4. The method of embodiment 2, wherein the immune cell is a dendritic cell.
5. The method of embodiment 2, wherein the immune cell is a T-cell.
6. The method of embodiment 5, wherein the T-cell is a cytotoxic T-cell.
7. The method of embodiment 2, wherein the immune cell is a natural killer cell.
8. The method of embodiment 2, wherein the immune cell is a B cell.
9. The method of embodiment 1, wherein the hetero-EPOR is on an endothelial cell.
10. The method of embodiment 1, wherein the binding of the EPO analog to the hetero-EPOR overcomes an immune tolerogenic state.
11. The method of embodiment 1, wherein the binding of the EPO analog to the hetero-EPOR overcomes an immune suppressive state.
12. The method of embodiment 1, wherein the cancer is a colon cancer, a breast cancer, a lung cancer, a brain cancer, or a melanoma.
13. The method of embodiment 1, further comprising the step of administering an anticancer agent.
14. The method of embodiment 13, wherein the anticancer agent is a chemotherapeutic, an anticancer antibody, an antibody-drug conjugate, an immunotherapy, a chimeric antigen receptor cell therapy, a radiotherapy, an alkylating agent, a plant alkaloid, an antitumor antibiotic, an antimetabolite, a topoisomerase inhibitor, or an anti-neoplastic.
15. A method, comprising the steps of: administering an anti-hetero-EPOR antibody to a patient, wherein the patient has a cancer, wherein the anti-hetero-EPOR antibody is an antagonist for a hetero-EPOR; and binding the anti-hetero-EPOR antibody to the hetero-EPOR thereby inhibiting the hetero-EPOR.
16. The method of embodiment 15, wherein the hetero-EPOR is on an immune cell.
17. The method of embodiment 16, wherein the immune cell is a macrophage.
18. The method of embodiment 16, wherein the immune cell is a dendritic cell.
19. The method of embodiment 16, wherein the immune cell is a T-cell.
20. The method of embodiment 19, wherein the T-cell is a cytotoxic T-cell.
21. The method of embodiment 16, wherein the immune cell is a natural killer cell.
22. The method of embodiment 16, wherein the immune cell is a B cell.
23. The method of embodiment 15, wherein the hetero-EPOR is on an endothelial cell.
24. The method of embodiment 15, wherein the binding of the anti-hetero-EPOR antibody to the hetero-EPOR overcomes an immune tolerogenic state.
25. The method of embodiment 15, wherein the binding of the anti-hetero-EPOR antibody to the hetero-EPOR overcomes an immune suppressive state.
26. The method of embodiment 15, wherein the cancer is a colon cancer, a breast cancer, a lung cancer, a brain cancer, or a melanoma.
27. The method of embodiment 15, further comprising the step of administering an anticancer agent.
28. The method of embodiment 27, wherein the anticancer agent is a chemotherapeutic, an anticancer antibody, an antibody-drug conjugate, an immunotherapy, a chimeric antigen receptor cell therapy, a radiotherapy, an alkylating agent, a plant alkaloid, an antitumor antibiotic, an antimetabolite, a topoisomerase inhibitor, or an anti-neoplastic.
29. A method, comprising the steps of: administering an anti-EPO antibody to a patient, wherein the patient has a cancer, wherein the anti-EPO antibody inhibits binding of an EPO to a hetero-EPOR; and binding the anti-EPO antibody to the EPO thereby inhibiting the hetero-EPOR.
30. The method of embodiment 29, wherein the hetero-EPOR is on an immune cell.
31. The method of embodiment 30, wherein the immune cell is a macrophage.
32. The method of embodiment 30, wherein the immune cell is a dendritic cell.
33. The method of embodiment 30, wherein the immune cell is a T-cell.
34. The method of embodiment 33, wherein the T-cell is a cytotoxic T-cell.
35. The method of embodiment 30, wherein the immune cell is a natural killer cell.
36. The method of embodiment 30, wherein the immune cell is a B cell.
37. The method of embodiment 29, wherein the hetero-EPOR is on an endothelial cell.

38. The method of embodiment 29, wherein the binding of the anti-EPO antibody to the EPO overcomes an immune tolerogenic state.

39. The method of embodiment 29, wherein the binding of the anti-EPO antibody to the EPO overcomes an immune suppressive state.

40. The method of embodiment 29, wherein the cancer is a colon cancer, a breast cancer, a lung cancer, or a melanoma.

41. The method of embodiment 29, further comprising the step of administering an anticancer agent.

42. The method of embodiment 41, wherein the anticancer agent is a chemotherapeutic, an anticancer antibody, an antibody-drug conjugate, an immunotherapy, a chimeric antigen receptor cell therapy, a radiotherapy, an alkylating agent, a plant alkaloid, an antitumor antibiotic, an antimetabolite, a topoisomerase inhibitor, or an anti-neoplastic.

43. A method, comprising the steps of: administering an EPO analog to a patient, wherein the EPO analog is an agonist for a hetero-EPOR; and binding the EPO analog to the hetero-EPOR thereby promoting a negative immune modulation in the patient.

44. The method of embodiment 43, wherein the negative immune modulation is an immunosuppressed state.

45. The method of embodiment 44, further the step of transplanting an organ, a bone marrow, or a plurality of stem cells for a plurality of circulating cells.

46. The method of embodiment 43, further comprising the step of administering a specific antigen, and wherein the negative immune modulation is an immunotolerogenic state to the antigen.

47. The method of embodiment 46, wherein the specific antigen is a recombinant protein, an antigen associated with an autoimmune disease, or an allergen.

48. The method of embodiment 43, wherein the patient has an autoimmune disease.

49. The method of embodiment 48, wherein the autoimmune disease is a rheumatoid arthritis, a systemic lupus erythematosus, or a multiple sclerosis.

50. The method of embodiment 43, wherein the patient has a systemic chronic inflammation.

51. A method, comprising the steps of: administering an anti-hetero-EPOR antibody to a patient, wherein the anti-hetero-EPOR antibody is an agonist for a hetero-EPOR; and binding the anti-hetero-EPOR antibody to the hetero-EPOR thereby promoting a negative immune modulation in the patient.

52. The method of embodiment 51, wherein the negative immune modulation is an immunosuppressed state.

53. The method of embodiment 51, further comprising the administration of an antigen, and wherein the negative immune modulation is an immunotolerogenic state to the antigen.

54. The method of embodiment 51, further the step of transplanting an organ, a bone marrow, or a plurality of stem cells for a plurality of circulating cells. 55. The method of embodiment 51, further comprising the step of administering a specific antigen so that the patient becomes immune tolerant to the antigen.

56. The method of embodiment 55, wherein the specific antigen is a recombinant protein, an antigen associated with an autoimmune disease, or an allergen.

57. The method of embodiment 51, wherein the patient has an autoimmune disease.

58. The method of embodiment 58, wherein the autoimmune disease is a rheumatoid arthritis, a systemic lupus erythematosus, or a multiple sclerosis.

59. The method of embodiment 51, wherein the patient has a systemic chronic inflammation.

60. A method, comprising the steps of: administering an EPO analog to a patient, wherein the patient has a cancer, wherein the EPO analog is an agonist for a homo-EPOR and does not activate the hetero-EPOR; and binding the EPO analog to the homo-EPOR thereby promoting erythropoiesis in the patient.

61. The method of embodiment 60, wherein the cancer is a colon cancer, a breast cancer, a lung cancer, a brain cancer, or a melanoma.

62. The method of embodiment 60, further comprising the step of administering an anticancer agent.

63. The method of embodiment 62, wherein the anticancer agent is a chemotherapeutic, an anticancer antibody, an antibody-drug conjugate, an immunotherapy, a chimeric antigen receptor cell therapy, a radiotherapy, an alkylating agent, a plant alkaloid, an antitumor antibiotic, an antimetabolite, a topoisomerase inhibitor, or an anti-neoplastic.

64. The method of embodiment 60, wherein the EPO analog is an antagonist for the hetero-EPOR.

65. The method of embodiment 60, wherein the EPO analog does not bind the hetero-EPOR.

66. A method, comprising the steps of: administering an anti-homo-EPOR antibody to a patient, wherein the patient has a cancer, wherein the anti-homo-EPOR antibody is an agonist for a homo-EPOR and does not activate the hetero-EPOR; and binding the anti-homo-EPOR antibody to the homo-EPOR thereby promoting erythropoiesis in the patient.

67. The method of embodiment 66, wherein the cancer is a colon cancer, a breast cancer, a lung cancer, a brain cancer, or a melanoma.

68. The method of embodiment 66, further comprising the step of administering an anticancer agent.

69. The method of embodiment 68, wherein the anticancer agent is a chemotherapeutic, an anticancer antibody, an antibody-drug conjugate, an immunotherapy, a chimeric antigen receptor cell therapy, a radiotherapy, an alkylating agent, a plant alkaloid, an antitumor antibiotic, an antimetabolite, a topoisomerase inhibitor, or an anti-neoplastic.

70. The method of embodiment 66, wherein the anti-homo-EPOR antibody is an antagonist for the hetero-EPOR.

71. The method of embodiment 66, wherein the anti-homo-EPOR antibody does not bind the hetero-EPOR.

72. A method, comprising the steps of: administering an anti-EPO antibody to a patient, wherein the patient has a cancer, wherein the anti-EPO antibody inhibits an EPO from binding a hetero-EPOR, wherein the EPO bound to the anti-EPO antibody can bind to a homo-EPOR; binding the anti-EPO antibody to the EPO; and binding the EPO or a complex of the EPO and the anti-EPO antibody to the homo-EPOR, thereby promoting erythropoiesis in the patient.

73. The method of embodiment 72, wherein the cancer is a colon cancer, a breast cancer, a lung cancer, a brain cancer, or a melanoma.

74. The method of embodiment 72, further comprising the step of administering an anticancer agent.

75. The method of embodiment 74, wherein the anticancer agent is a chemotherapeutic, an anticancer antibody, an antibody-drug conjugate, an immunotherapy, a chimeric antigen receptor cell therapy, a radiotherapy, an alkylating agent, a plant alkaloid, an antitumor antibiotic, an antimetabolite, a topoisomerase inhibitor, or an anti-neoplastic.

76. The method of embodiment 72, further comprising the step of administering an EPO to the patient.

77. A method, comprising the steps of: administering a nucleic acid encoding an EPO analog to a patient, wherein the EPO analog is an agonist for a hetero-EPOR; expressing nucleic acid encoding the EPO analog in a cell in a patient after the cell has taken up the nucleic acid; secreting the EPO analog from the cell; and binding the EPO analog to the hetero-EPOR thereby promoting a negative immune modulation in the patient.

78. The method of embodiment 77, wherein the negative immune modulation is an immunosuppressed state.

79. The method of embodiment 77, further comprising the administration of an antigen, and wherein the negative immune modulation is an immunotolerogenic stated to the antigen.

80. The method of embodiment 79, wherein the antigen is administered as a nucleic acid encoding the antigen.

81. The method of embodiment 80, wherein the nucleic acid is an RNA. 82. The method of embodiment 77, further the step of transplanting an organ, a bone marrow, or a plurality of stem cells for a plurality of circulating cells.

83. The method of embodiment 77, further comprising the step of administering a specific antigen so that the patient becomes immune tolerant to the antigen.

84. The method of embodiment 83, wherein the specific antigen is a recombinant protein, an antigen associated with an autoimmune disease, or an allergen.

85. The method of embodiment 77, wherein the patient has an autoimmune disease.

86. The method of embodiment 85, wherein the autoimmune disease is a rheumatoid arthritis, a systemic lupus erythematosus, or a multiple sclerosis.

87. The method of embodiment 77, wherein the patient has a systemic chronic inflammation.

88. The method of embodiment 77, wherein the nucleic acid is part of a composition with a lipid nanoparticle.

89. A method, comprising the steps of: administering an siRNA to a patient, wherein the siRNA binds to mRNA encoding an EPOR, a CD131 or an EPO, wherein the patient has a cancer; and decreasing expression of the EPOR, the CD131, or the EPO, thereby inhibiting activation of a hetero-EPOR.

90. A method, comprising the steps of: administering an siRNA to a patient, wherein the siRNA binds to mRNA encoding an EPOR, a CD131 or an EPO; and decreasing expression of the EPOR, the CD131, or the EPO, thereby reducing a negative immune modulation in the patient.

91. The method of embodiment 90, wherein the negative immune modulation is an immunosuppressed state.

92. The method of embodiment 90, wherein an antigen is administered with the siRNA, and wherein the negative immune modulation is an immunotolerogenic state for the antigen.

93. The method of embodiment 92, wherein the antigen is administered as a nucleic acid encoding the antigen.

94. The method of embodiment 93, wherein the nucleic acid is an RNA.

95. A method, comprising the steps of: administering a HIF inhibitor to a patient; and reducing expression of a hetero-EPOR thereby reducing a negative immune modulation in the patient.

96. The method of embodiment 95, wherein the negative immune modulation is an immunosuppressed state.

97. The method of embodiment 95, wherein an antigen is administered with the PHD inhibitor, and wherein the negative immune modulation is an immunotolerogenic state for the antigen. 98. A method, comprising the steps of: administering a PHD inhibitor to a patient; and increasing expression of a hetero-EPOR, thereby promoting a negative immune modulation in the patient.

99. The method of embodiment 98, wherein the negative immune modulation is an immunosuppressed state.

100. The method of embodiment 98, wherein an antigen is administered with the PHD inhibitor, and wherein the negative immune modulation is an immunotolerogenic state for the antigen.

OTHER EMBODIMENTS

In some aspects, provided herein is a composition comprising an antibody or a functional fragment thereof, wherein: (i) said antibody or said functional fragment thereof selectively binds to a target comprising an erythropoietin (EPO) protein, an EPO receptor subunit, a CD131 subunit, or a combination thereof, (ii) binding of said antibody or said functional fragment thereof to said target prevents (a) formation of an EPO protein-hetero-EPO receptor complex, wherein said hetero-EPO receptor comprises said EPO receptor subunit and said CD131 subunit, (b) formation of a hetero-EPO receptor between said EPO receptor subunit and said CD131 subunit; and (iii) said antibody or said functional fragment thereof comprises an antigen binding domain, or (c) activation of a hetero-EPO receptor, wherein said hetero-EPO receptor comprises said EPO receptor subunit and said CD131 subunit; and (iii) said antibody or said functional fragment thereof comprises an antigen binding domain.

In some embodiments, said antigen binding domain comprises a heavy chain variable region (VH) comprising a VH complementarity determining region 1 (VH-CDR1) sequence, a VH-CDR2 sequence, and a VH-CDR3 sequence; and a light chain variable region (VL) comprising a VL-CDR1 sequence, a VL-CDR2 sequence, and a VL-CDR3 sequence; a VH and a kappa chain variable regions (VK); or a VH and a lamda chain variable regions.

In some embodiments, said preventing formation of said EPO protein-hetero-EPO receptor complex or formation of said hetero-EPO receptor between said EPO receptor subunit and said CD131 subunit inhibits immune tolerance.

In some embodiments, said preventing formation of said EPO protein-hetero-EPO receptor complex or formation of said hetero-EPO receptor between said EPO receptor subunit and said CD131 subunit promotes differentiation of a plurality of naïve T cells into a plurality of effector T cells. In some embodiments, said plurality of effector T cells expresses Cluster of Differentiation 45 (CD45), CD3, CD8, Perforin, Interferon gamma (IFNγ), Granzyme B, or tumor necrosis factor alpha (TNFα). In some embodiments, said preventing formation of said EPO protein-hetero-EPO receptor complex or formation of said hetero-EPO receptor between said EPO receptor subunit and said CD131 subunit inhibits differentiation of a plurality of naïve T cells into a plurality of regulatory T cells. In some embodiments, said plurality of regulatory T cells expresses Cluster of Differentiation 4 (CD4), CD25, CD127, Forkhead Box P3 (FoxP3), CD39, protein tyrosine phosphatase receptor type C (CD45RA), Interleukin-2 (TL-2), or a Cytotoxic T-Lymphocyte Associated Protein 4 (CTLA-4). In some embodiments, said preventing formation of said EPO protein-hetero-EPO receptor complex or formation of said hetero-EPO receptor between said EPO receptor subunit and said CD131 subunit increases a plurality of progenitor exhausted T cells. In some embodiments, said plurality of progenitor exhausted T cells expresses Cluster of Differentiation 44 (CD44), Signaling lymphocyte activation molecule family member 6 (SLAMF6) or T cell factor 1 (TCF1).

In some embodiments, said preventing formation of said EPO protein-hetero-EPO receptor complex or formation of said hetero-EPO receptor between said EPO receptor subunit and said CD131 subunit stimulates immune response in cancer. In some embodiments, said preventing formation of said EPO protein-hetero-EPO receptor complex or formation of said hetero-EPO receptor between said EPO receptor subunit and said CD131 subunit renders cancer cells sensitive to an immune checkpoint inhibitor. In some embodiments, said immune checkpoint inhibitor comprises a Cytotoxic T-Lymphocyte Associated Protein 4 (CTLA-4) inhibitor, a Programmed Death 1 (PD-1) inhibitor, or a Programmed Death Ligand 1 (PD-L1) inhibitor. In some embodiments, said CTLA-4 inhibitor comprises an anti-CTLA-4 antibody. In some embodiments, said PD-1 inhibitor comprises an anti-PD-1 antibody. In some embodiments, said PD-L1 inhibitor comprises an anti-PD-L1 antibody. In some embodiments, said preventing formation of said EPO protein-hetero-EPO receptor complex or formation of said hetero-EPO receptor between said EPO receptor subunit and said CD131 subunit attenuates tumor growth.

In some embodiments, said antibody or said functional fragment thereof is an IgG, an IgM, an IgE, an IgA, an IgD, is derived therefrom, or a combination thereof. In some embodiments, said antibody or said functional fragment thereof comprises a monoclonal antibody, a grafted antibody, a chimeric antibody, a human antibody, a humanized antibody, or a combination thereof.

In some embodiments, said antigen binding domain comprises a Fab, a Fab', a (Fab')2, a variable fragment (Fv), a single chain variable fragment (scFv), a scFv-Fc, a Fab-Fc, a VHH, a non-antibody scaffold, or a combination thereof. In some embodiments, said antigen binding domain is isolated, recombinant, synthetic, or a combination thereof.

In some embodiments, said VH-CDR3 comprises an amino acid sequence with at least 80% sequence identity to any one of SEQ ID NOs: 63-250. In some embodiments, said VH-CDR3 comprises an amino acid sequence with at least 80% sequence identity to any one of SEQ ID NOs: 815-943. In some embodiments, said VH-CDR3 comprises an amino acid sequence with at least 80% sequence identity to any one of SEQ ID NOs: 1331-1466.

In some embodiments, said VL-CDR3 comprises an amino acid sequence with at least 80% sequence identity to any one of SEQ ID NOs: 251-438. In some embodiments, said VL-CDR3 comprises an amino acid sequence with at least 80% sequence identity to a sequence of SEQ ID NOs: 944-1072. In some embodiments, said VL-CDR3 comprises an amino acid sequence with at least 80% sequence identity to any one of SEQ ID NOs: 1467-1602.

In some embodiments, said VH comprises an amino acid sequence with at least 80% sequence identity to any one of SEQ ID NOs: 439-626. In some embodiments, said VH comprises an amino acid sequence with at least 80% sequence identity to any one of SEQ ID NOs: 1073-1201. In some embodiments, said VH comprises an amino acid sequence with at least 80% sequence identity to any one of SEQ ID NOs: 1603-1738. In some embodiments, said VL comprises an amino acid sequence with at least 80% sequence identity to any one of SEQ ID NOs: 627-814. In some embodiments, said VL comprises an amino acid sequence with at least 80% sequence identity to any one of SEQ ID NOs: 1202-1330. In some embodiments, said VL comprises an amino acid sequence with at least 80% sequence identity to any one of SEQ ID NOs: 1739-1874.

In some aspects, provided herein is a composition comprising a nucleic acid sequence encoding said antibody or said functional fragment thereof of any of the compositions described herein. In some aspects, provided herein is a cell comprising any of the compositions described herein.

In some aspects, provided herein is a method of treating a disease or a condition in a subject in need thereof, said method comprising administering to said subject any of the compositions described herein. In some embodiments, said method further comprises inhibiting immune tolerance in said subject. In some embodiments, said inhibiting immune tolerance comprises increasing immune response to a vaccine, when said vaccine is administered to said subject. In some embodiments, said inhibiting immune tolerance comprises increasing immune response to a viral or bacterial infection in said subject. In some embodiments, wherein said inhibiting immune tolerance comprises increasing immune response to an antigen produced by cancer. In some embodiments, said disease or said condition comprises a cancer or an infection. In some embodiments, said cancer comprises a lung cancer, a breast cancer, a colon cancer, a brain cancer, a melanoma, hepatocarcinoma, or a liver cancer. In some embodiments, said cancer is a melanoma. In some embodiments, said cancer is a liver cancer. In some embodiments, said cancer is a colon cancer. In some embodiments, said cancer is a breast cancer.

In some aspects, provided herein is a method treating cancer, wherein said method comprises administering a composition or a derivative thereof to a subject having cancer or at risk of having cancer, wherein said composition or said derivative thereof inhibits a hetero-erythropoietin (EPO) receptor activity in said subject. In some embodiments, said hetero-EPO receptor is expressed on a myeloid cell.

In some aspects, provided herein, is a composition comprising an antibody or a functional fragment thereof, wherein: (i) said antibody or said functional fragment thereof selectively binds to a target comprising an erythropoietin (EPO) protein, an EPO receptor subunit, a CD131 subunit, or a combination thereof, (ii) binding of said antibody or said functional fragment thereof to said target promotes (a) formation of an EPO protein-hetero-EPO receptor complex, wherein said hetero-EPO receptor comprises said EPO receptor subunit and said CD131 subunit, (b) formation of a hetero-EPO receptor between said EPO receptor subunit and said CD131 subunit, or (c) activation of a hetero-EPO receptor, wherein said hetero-EPO receptor comprises said EPO receptor subunit and said CD131 subunit; and (iii) said antibody or said functional fragment thereof comprises an antigen binding domain.

In some embodiments, said antigen binding domain comprises a heavy chain variable region (VH) comprising a VH complementarity determining region 1 (VH-CDR1) sequence, a VH-CDR2 sequence, and a VH-CDR3 sequence; and a light chain variable region (VL) comprising a VL-CDR1 sequence, a VL-CDR2 sequence, and a VL- CDR3 sequence; a VH and a kappa chain variable regions (VK); or a VH and a lamda chain variable regions.

In some embodiments, said promoting formation of said EPO protein-hetero-EPO receptor complex, formation of said hetero-EPO receptor between said EPO receptor subunit and said CD131 subunit, or activation of said hetero-EPO receptor between said EPO receptor subunit and said CD131 subunit induces antigen-specific immune tolerance. In some embodiments, said promoting formation of said EPO protein-hetero-EPO receptor complex, formation of said hetero-EPO receptor between said EPO receptor subunit and said CD131 subunit, or activation of said hetero-EPO receptor between said EPO receptor subunit and said CD131 subunit inhibits differentiation of a plurality of naïve T cells into a plurality of effector T cells. In some embodiments, said plurality of effector T cells expresses Cluster of Differentiation 45 (CD45), CD3, CD8, Perforin, Interferon gamma (IFNγ), Granzyme B, or tumor necrosis factor alpha (TNFα). In some embodiments, said promoting formation of said EPO protein-hetero-EPO receptor complex, formation of said hetero-EPO receptor between said EPO receptor subunit and said CD131 subunit, or activation of said hetero-EPO receptor between said EPO receptor subunit and said CD131 subunit promotes differentiation of a plurality of naïve T cells into a plurality of regulatory T cells. In some embodiments, said plurality of regulatory T cells expresses Cluster of Differentiation 4 (CD4), CD25, CD127, Forkhead Box P3 (FoxP3), CD39, protein tyrosine phosphatase receptor type C (CD45RA), Interleukin-2 (IL-2), or a Cytotoxic T-Lymphocyte Associated Protein 4 (CTLA-4).

In some embodiments, said antibody or said functional fragment thereof does not affect a homo-EPO receptor activity. In some embodiments, said antibody or said functional fragment thereof does not bind a homo-EPO receptor comprising at least two EPO receptor subunits.

In some embodiments, said promoting formation of said EPO protein-hetero-EPO receptor complex, formation of said hetero-EPO receptor between said EPO receptor subunit and said CD131 subunit, or activation of said hetero-EPO receptor between said EPO receptor subunit and said CD131 subunit reduces immune reaction when administered to a subject having an autoimmune disease or a subject with a transplanted organ. In some embodiments, said transplanted organ comprises bone marrow, kidney, liver, lung, or heart. In some embodiments, said autoimmune disease comprises a rheumatoid arthritis, a systemic lupus erythematosus, or a multiple sclerosis.

In some embodiments, said promoting formation of said EPO protein-hetero-EPO receptor complex, formation of said hetero-EPO receptor between said EPO receptor subunit and said CD131 subunit, or activation of said hetero-EPO receptor between said EPO receptor subunit and said CD131 subunit reduces systemic chronic inflammation when administered to a subject suffering from a systemic chronic inflammation.

In some embodiments, said antibody or said functional fragment thereof is an IgG, an IgM, an IgE, an IgA, an IgD, is derived therefrom, or a combination thereof. In some embodiments, said antibody or said functional fragment thereof comprises a monoclonal antibody, a grafted antibody, a chimeric antibody, a human antibody, a humanized antibody, or a combination thereof. In some embodiments, said antigen binding domain comprises a Fab, a Fab', a (Fab')2, a variable fragment (Fv), a single chain variable fragment (scFv), a scFv-Fc, a Fab-Fc, a VHH, a non-antibody scaffold, or a combination thereof. In some embodiments, said antigen binding domain is isolated, recombinant, synthetic, or a combination thereof.

In some embodiments, said VH-CDR3 comprises an amino acid sequence with at least 80% sequence identity to any one of SEQ ID NOs: 63-250. In some embodiments, said VH-CDR3 comprises an amino acid sequence with at least 80% sequence identity to any one of SEQ ID NOs: 815-943. In some embodiments, said VH-CDR3 comprises an amino acid sequence with at least 80% sequence identity to any one of SEQ ID NOs: 1331-1466.

In some embodiments, said VL-CDR3 comprises an amino acid sequence with at least 80% sequence identity to any one of SEQ ID NOs: 251-438. In some embodiments, said VL-CDR3 comprises an amino acid sequence with at least 80% sequence identity to any one of SEQ ID NOs: 944-1072. In some embodiments, said VL-CDR3 comprises an amino acid sequence with at least 80% sequence identity to any one of SEQ ID NOs: 1467-1602.

In some embodiments, said VH comprises an amino acid sequence with at least 80% sequence identity to any one of SEQ ID NOs: 439-626. In some embodiments, said VH comprises an amino acid sequence with at least 80% sequence identity to any one of SEQ ID NOs: 1073-1201. In some embodiments, said VH comprises an amino acid sequence with at least 80% sequence identity to any one of SEQ ID NOs: 1603-1738. In some embodiments, said VL comprises an amino acid sequence with at least 80% sequence identity to any one of SEQ ID NOs: 627-814. In some embodiments, said VL comprises an amino acid sequence with at least 80% sequence identity to any one of SEQ ID NOs: 1202-1330. In some embodiments, said VL comprises an amino acid sequence with at least 80% sequence identity to any one of SEQ ID NOs: 1739-1874.

In some embodiments, said antibody further comprises a binding domain that selectively binds to an antigen associated with tumor, a cell surface marker associated with immune cells, or a signaling molecule associated with immune cells. In some embodiments, said antigen associated with tumor is selected from the group consisting of PD1, HER2, EpCAM, CEA, CEACAM5, EGFR, CD33, CD19, CD20, CD22, and any combinations thereof. In some embodiments, said cell surface marker is DEC205, XCR1, or XCL1. In some embodiments, said signaling molecule is PD-L1, Tim3, or TREM2.

In some aspects, provided herein, is a composition comprising a nucleic acid sequence encoding said antibody or said functional fragment thereof of any of the compositions described herein. In some aspects, provided herein, is a cell comprising any of the compositions described herein.

In some aspects, provided herein, is a method of treating a disease or a condition in a subject in need thereof, said method comprising administering to said subject any of the compositions described herein. In some embodiments, said disease or said condition comprises an autoimmune disease. In some embodiments, said subject has received or is to receive an organ transplant or a foreign therapeutics protein.

EXAMPLES

Example 1. EPO Analogs/Engineered EPOs

Eight types of EPO analogs can be engineered. EPO analogs can bind the hetero-EPOR and not the homo-EPOR, and can be either agonists or antagonists of the hetero-EPOR. Other EPO analogs can bind the homo-EPOR and not the hetero-EPOR, and can be either agonists or antagonists of the homo-EPOR. EPO analogs can bind both the homo-EPOR and the hetero-EPOR and be agonists of both, antagonists of both, or agonist of one and antagonist of the other.

Human EPO analogs that bind the hetero-EPOR (as an agonist) and do not bind the homo-EPOR are engineered. These EPO analogs can be expressed as Fc fusion proteins. EPO mutations of K20E, T44I, K45I, V46A, F48G, R143A, R150A, R150Q, L155A, and L155N in the site 1 have been shown to lose the in vitro bioactivity against the homo-EPOR >5 times, whereas mutations of K45I, N147K, R150E, and G151A in the stie 1 have been shown to lose the activity >50 times. These mutations lead to much reduced affinity to homo-EPOR. These mutations do not affect helix B and may still bind to the hetero-EPOR.

EPO analogs that bind the hetero-EPOR (as an agonist) and bind the homo-EPOR (as an antagonist) are engineered. The EPO analogs with mutations that reduce activation of the homo-EPOR may allow binding. For example, EPO mutations of V11S, R14A, R14E, Y15I, K97A, K97E, S104A, L108A, and R110E in the site 2 have been shown to lose the in vitro bioactivity of the homo-EPOR >5 times, whereas mutations of R14Q, S100E, S100T, R103A, R103E, R103H, R103N, R103Q, S104I, and L108K in the site 2 have been shown to lose the activity >50 times. These mutations do not affect helix B and so these mutants should bind to the hetero-EPOR, and act as an antagonist of the homo-EPOR.

The mutations in the site 1 and 2 may be combined to make human EPO analogs that bind the hetero-EPOR (as an agonist) with or without binding to the homo-EPOR (as an antagonist). Other examples of EPO analogs that bind the hetero-EPOR (as an agonist) and have reduced binding or do not bind the homo-EPOR are the helix B peptides described above.

Human EPO analogs that bind the hetero-EPOR (as an antagonist) and do not bind the homo-EPOR are engineered. These EPO analogs can be expressed as Fc fusion proteins. The surface residues (Q58, E62, Q65, L69, E72, R76, A79, L80, N83, S84, and S85) in the helix B are expected to play important roles in interaction with the hetero-EPOR, and will be mutated. For example, the nucleic acid encoding helix B can be mutagenized using alanine scanning and/or saturation mutagenesis. The mutations that bind the hetero-EPOR and are reduced for activation of the hetero-EPOR (but still bind the hetero-EPOR) can be combined with mutations described above that reduce EPO analog binding to the homo-EPOR. The resulting EPO analog antagonizes the hetero-EPOR and has reduced binding or does not bind to the homo-EPOR.

EPO analogs that bind the homo-EPOR (as an agonist) and do not bind the hetero-EPOR are engineered. The helix B mutations described above are screened for mutations that reduce binding to the hetero-EPOR. These EPO analogs are agonists for the homo-EPOR and have reduced or no binding to the hetero-EPOR.

EPO analogs that bind the homo-EPOR (as an antagonist) and do not bind the hetero-EPOR are engineered. These EPO analogs can be expressed as Fc fusion proteins. The helix B mutations described above are screened for mutations that reduce binding to the hetero-EPOR. These helix B mutations are combined with EPO mutations that reduce activation of the homo-EPOR but allow binding. For example, EPO mutations of V11S, R14A, R14E, Y15I, K97A, K97E, S104A, L108A, and R110E in the site 2 have been shown to lose the in vitro bioactivity >5 times, whereas mutations of R14Q, S100E, S100T, R103A, R103E, R103H, R103N, R103Q, S104I, and L108K in the site 2 have been shown to lose the activity >50 times. These EPO analogs retain affinity binding to homo-EPOR but lose the signaling activity, and so, can be antagonists of the homo-EPOR and the helix B mutations reduce binding to the hetero-EPOR.

Human EPO analogs that bind the homo-EPOR (as an agonist) and the hetero-EPOR (as an antagonist) are engineered. These EPO analogs can be expressed as Fc fusion proteins. The EPO analogs with mutations in helix B that reduce activity but allow binding can be antagonists of the hetero-EPOR. EPO helixes A, C and D are not changed and so can act as an agonist at the homo-EPOR.

Human EPO analogs that bind the homo-EPOR (as an antagonist) and the hetero-EPOR (as an antagonist) are engineered. The EPO analogs with mutations in helix B that reduce activity but allow binding can be antagonists of the hetero-EPOR. These mutations are combined with EPO mutations that result in antagonists for homo-EPOR. For example, EPO mutations of V11S, R14A, R14E, Y15I, K97A, K97E, S104A, L108A, and R110E in the site 2 have been shown to lose the in vitro bioactivity >5 times, whereas mutations of R14Q, S100E, S100T, R103A, R103E, R103H, R103N, R103Q, S104I, and L108K in the site 2 have been shown to lose the activity >50 times. These mutations are combined with the helix B mutations that make hetero-EPOR antagonists, and so, these EPO analogs should antagonize both the hetero-EPOR and the homo-EPOR.

Example 2. Expression of Human EPO Analogs/Engineered EPOs cDNAs for each human EPO analog are synthesized and fused with the human immunoglobulin Fc domain or albumin. The fusion proteins are cloned into a mammalian expression vector under the control of a hEF1α promoter. A linker maybe inserted between the domains. The vector contains a Puromycin resistant gene for mammalian cell selection and an Ampicillin resistant gene for *E. coli* propagation. All fusion proteins contained a signal peptide at the N-terminal for secretion out of the cells. Expression vector plasmids are used to transfect 100 ml of 293 cells transiently. The culture media is harvested after 72 hours and the fusion protein is purified.

Example 3. In Vitro Binding by EPO Analogs/Engineered EPOs

The ability of the EPO analogs to bind to the extracellular domains of the homo-EPOR, hetero-EPOR, or CD131/CD131 is determined in a functional ELISA. Soluble homo-EPOR, CD131/CD131, and hetero-EPOR (Sino Biological) are coated on a standard ELISA. The wells are blocked with 2% BSA. Dilutions of the EPO analogs are added to the plates and incubated. After washing, the bound EPO analogs are detected using biotinylated polyclonal anti-EPO (R&D Systems) followed by streptavidin HRP conjugate or other appropriate secondary antibodies. After washing, TMB reagent (Sigma) is added and OD absorption at 450 nm is measured in a plate reader.

Example 4. Cell Binding by EPO Analogs/Engineered EPOs

The EPO analogs are used to stain cells expressing one (or more) of the homo-EPOR, hetero-EPOR, and/or CD131/CD131. 293 cells expressing EPOR, CD131, or EPOR and CD131 are generated by lentiviral transduction. Expression of the homo-EPOR or CD131/CD131, and/or the hetero- EPOR are confirmed by staining with commercial anti-EPOR and anti-CD131 antibodies. Human leukemic UT-7 cells, erythroleukemia TF-1 cells, monocytic THP-1 cells are known to express EPOR and CD131 and will be used to confirm binding of the EPO analogs. Murine erythroid progenitor cells expressing the homo-EPOR and myeloid cells expressing the hetero-EPOR can also be used to confirm the binding of the EPO analogs. For the staining experiments, the cells are incubated with the EPO analogs. After washing, the bound EPO variants are detected using biotinylated polyclonal anti-EPO (R&D Systems) followed by streptavidin PE conjugate or other appropriate secondary antibodies. Staining of the EPO analogs is quantified.

Example 5. Activation of Homo-EPOR and Hetero-EPOR

The receptor expressing cells (homo-EPOR, hetero-EPOR, or CD131/CD131) are serum-starved for 24 hours, and then incubated in the culture medium containing the EPO analogs. Cell lysates are made from these cells, and the lysates are then subjected to Western blotting analysis with antibodies against phosphorylated EPOR, CD131, JAK2, and STAT5. Alternatively, activation of the receptors can be assessed with a STAT5-luciferase reporter. Activation of homo-EPOR, hetero-EPOR, or CD131/CD131 by ligand binding leads to phosphorylation of the intracellular domains of the receptor and downstream JAK2 and STAT5.

Example 6. Erythropoiesis Stimulating Activity and/or Antigen Specific Tolerance Activity of EPO Analogs Proliferation of human erythroleukemia TF-1 cells depends on activation of the homo-EPOR. TF-1 cells are treated with different concentrations of EPO analogs, and TF-1 cell proliferation is characterized.

Induction of FoxP3$^+$ T$_{reg}$ is mediated by activation of the hetero-EPOR on antigen presenting cells. Human peripheral blood CD4$^+$ T-cells are co-cultured with CD14$^+$ monocytes under anti-CD3 stimulation. In the presence of both IL-2 and EPO analogs, induction of Fox3$^+$ Tregs is characterized.

Separately, murine bone marrow derived EpoR+ and EpoR− cDC1 cells are loaded with OVA in vitro and co-cultured with naïve OT-II cells in the presence of EPO analogs. De novo induction of FoxP3 T-cells are used to indicate antigen-specific tolerance promoting activities of EPO analogs.

Example 7. Pharmacokinetic Assessment of EPO Analogs

EPO analogs are injected subcutaneously (s.c.) or intraperitoneally (i.p.) into mice. Serum samples are taken at different time points for up to 10 days after the injection. Concentrations of the fusion protein in the serum samples are determined using a sandwiched ELISA assay.

Example 8. Erythropoietic Activity of EPO Analogs

Normocythemic mice are injected s.c. or i.p. with EPO analogs. The mice can be engineered to express human homo-EPOR in progenitor red blood cells. Blood samples are taken at various times. The hemoglobulin levels, hematocrit and reticulocyte counts are determined. The frequencies of the erythroid progenitors in bone marrow and spleen are measured, and the effects of different EPO analogs on the medullary and extramedullary erythropoiesis are determined, respectively. Expansion of the splenic EPOR+ cDC1s and red pulp MΦs is used to assess activation of the hetero-EPOR.

Example 9. Induction of Immune Tolerance by EPO Analogs in Transplantation

BALB/c recipients of C57BL/6J heart transplants are treated with EPO analogs that are agonists for the hetero-EPOR/CD131 or vehicle control for the initial 3 days after transplantation, with or without a single perioperative dose of CTLA4-Ig. Vehicle-treated recipients reject the grafts in about a week, while tolerogenic EPO analogs prolong graft survival for >14 days. CTLA4-Ig prolongs graft survival to about 6 weeks and combination therapy with CTLA4-Ig plus tolerogenic EPO analogs act synergistically to prolong graft survival to over 10 weeks.

In addition, since autologous apoptotic cells preceding transplantation enhance survival in lethal murine graft-versus-host (GvHD) models, tolerogenic EPO analogs are administrated together with extracorporeal photopheresis (ECP) induced apoptotic cells to prevent GvHD and enhance survival. BALB/c mice are injected with C57BL/6J T-cell-depleted BM (TCD-BM) plus conventional T-cells only or with prior injection of ECP-treated BALB/c cells. ECP treatment 48 hours prior to bone marrow transplantation (BMT) in C57BL/6→BALB/c mice improves survival. Tolerogenic EPO analogs are given for 10 days, starting from the same day as ECP-induced apoptotic cell administration. The group treated with ECP only is expected to exhibit a significant improvement in survival (median survival of about 5 weeks versus about 1 week) with surviving mice showing no signs of GvHD. Co-administration of tolerogenic EPO analogs is expected to further improve survival.

Example 10. Enhancement of Antigen-Specific Tolerance with EPO Analogs

Specific antigens can be delivered to dendritic cells (DCs), e.g., type 1 conventional dendritic cells (cDC1) by antibody mediated antigen delivery through anti-DEC205 (Bonifaz, 2002) which specifically recognizes and binds DC. Ovalbumin (OVA) or MOG (Myelin oligodendrocyte glycoprotein) is conjugated to anti-mouse DEC205 (DEC205, Bio X Cell) for delivery to cDC1s.

C57BL/6J mice are immunized with anti-DEC205 conjugated with OVA (0.3-30 g) s.c. in the footpad, and simultaneously injected s.c. or i.p. with EPO analogs that are agonists of the hetero-EPOR, or PBS (control). De novo induction of FoxP3 T-cells in the adoptively transferred naïve cells in the draining lymph node and spleen are used to indicate an antigen-specific tolerance effect on CD4+ T cells, i.e., increased induction of Foxp3+ T$_{regs}$. Similarly, the fate of adoptively transferred OTI cells will be monitored to check the antigen-specific tolerance promoting effect on CD8+ T cells, i.e., more potent deletion of antigen-specific CD8+ T cells.

In addition, animals are rechallenged with OVA in complete freund's adjuvant (CFA) on day 8. Serum samples are taken at day 15 and day 30, and anti-OVA IgG titers are determined by ELISA. Challenging the mice with an unrelated antigen such as Keyhole Limpet Hemocyanin (KLH) and measurement of anti-KLH specific IgG antibody titers serve as a control for the OVA-specific tolerance achieved by anti-DEC205 specific OVA delivery.

In addition, anti-DEC205 conjugated with MOG is administrated s.c. into the footpad of C57BL/6J mice together with EPO analogs that are agonists of the hetero-EPOR. Other Ag-delivery sites will also be tested, such as lung. MOG-specific 2D2 TCR transgenic naïve CD4+ T cells are adoptively transferred 1 day before antigen immunization with EPO analog co-administration. De novo FoxP3 T cell induction from the adoptively transferred congenic 2D2 cells is analyzed to indicate antigen-specific tolerance inducing activity. To evaluate the in vivo suppressive function of anti-DEC205-delivery antigen and EPO analogs, antigen-specific FoxP3+ 2D2 cells are sorted by flow cytometry for testing in in vitro antigen-specific T-cell immune suppression assays.

Moreover, experimental autoimmune encephalomyelitis (EAE) is induced in mice immunized with anti-DEC205-MOG with or without EPO analogs that are agonists for the hetero-EPOR. The severity score of EAE is determined over time. The EPO analogs promote antigen-specific tolerance and ameliorate EAE.

Example 11. Antigen Specific Tolerance Induced In Vivo with Lipid Nanoparticles (LNP) Encapsulating mRNAs Encoding Antigen Nanoparticles injected into the circulatory or lymphatic systems are predominantly captured by macrophages in the reticuloendothelial system (for example, in liver, spleen), and can also be captured by precursor DCs present in the blood and immature DCs residing in peripheral tissues (Cifuentes-Rius et al, Nat Nanotechnol. 2021:16(1):37-46). mRNAs encoding specific antigens, e.g., ovalbumin or MOG, are encapsulated in LNP. EPO analogs that are agonists of the hetero-EPOR are administered as recombinant proteins or co-encapsulated with the mRNA encoding the antigen. In vivo antigen-specific tolerance-enhancing effects are monitored as described in Example 10.

Alternatively, mRNA encoding the EPO analogs that are agonists of the hetero-EPOR are used, instead of the EPO analogs, to generate the LNP to induce antigen-specific tolerance.

Example 12. Antibodies Against the Hetero-EPOR

Antibodies against the hetero-EPOR are generated with animal immunization. The extracellular domains of EPOR, CD131, or the soluble heterodimeric EPOR/CD131 are used to immunize the animals. The antigen specific B cells or hybridoma cells are isolated and the immunoglobulin genes are sequenced. The recombinant antibodies can be subjected to the antigen binding assays with the extracellular domains of homo-EPOR, CD131/CD131, or the soluble hetero-EPOR, and the staining assays on the cells expressing EPOR only, CD131 only, or both EPOR and CD131. The cells staining with antibodies specific to the hetero-EPOR are further characterized for receptor activation by analyzing phosphorylation of the receptor, JAK2, and STAT5 after the receptor expressing cells are treated with the antibody with or without EPO.

Alternatively, the hetero-EPOR specific antibody can be isolated by screening an antibody expression library, e.g., phage display, yeast display, ribosomal display, or cell display.

Anti-hetero-EPOR antibodies can be agonists or antagonists for hetero-EPOR. Some anti-hetero-EPOR antibodies can be agonists or antagonists for the homo-EPOR or CD131/CD131 receptors.

The binding affinity of the hetero-EPOR antibodies to the extracellular domains of a hetero-EPOR, or a CD131/CD131 is determined using a functional ELISA. Soluble CD131/CD131, and hetero-EPOR (Sino Biological) are coated on a standard ELISA. The wells are blocked with 2% BSA. Dilutions of anti-hetero-EPOR antibodies are added to the plates and incubated. After washing, the bound anti-hetero-EPOR antibodies are detected using biotinylated polyclonal anti-EPO (R&D Systems) followed by streptavidin HRP conjugate or other appropriate secondary antibodies. After washing, TMB reagent (Sigma) is added and OD absorption at 450 nm is measured in a plate reader.

Example 13. Characterization of Antibodies Against the Human EPO

Antibodies against human EPO that block interaction between EPO and the hetero-EPOR are generated with animal immunization. The antigen specific B cells or hybridoma cells are isolated and sequenced. The recombinant antibodies are assayed in the antigen binding assay and the receptor activation assay. The anti-EPO antibodies are tested for antagonist activity against the homo-EPOR and/or the hetero-EPOR. Anti-EPO antibodies can block EPO-mediated activation of the hetero-EPOR but not the homo-EPOR, or block activation of the homo-EPOR and not the hetero-EPOR, or block activation of both the homo-EPOR and the hetero-EPOR.

The binding affinity of anti-EPO antibodies to the extracellular domains of a homo-EPOR, a hetero-EPOR, or a CD131/CD131 is determined using a functional ELISA. Soluble homo-EPOR, CD131/CD131, and hetero-EPOR (Sino Biological) are coated on a standard ELISA. The wells are blocked with 2% BSA. Dilutions of anti-EPO antibodies are added to the plates and incubated. After washing, the bound anti-EPO antibodies are detected using biotinylated polyclonal anti-EPO (R&D Systems) followed by streptavidin HRP conjugate or other appropriate secondary antibodies. After washing, TMB reagent (Sigma) is added and OD absorption at 450 nm is measured in a plate reader.

Example 14. Characterization of the Immune Stimulatory Roles of the Antagonistic Anti-Hetero-EPOR and Anti-EPO Antibodies in an In Vivo Tumor Model Murine colon adenocarcinoma MC38 is used to test the antagonistic, anti-hetero-EPOR antibodies, and neutralizing, anti-EPO antibodies (neutralizing for activity with the hetero-EPOR). MC38 cells are engrafted (s.c.) in the right flanks of C57BL/6 mice. The mice are treated (i.p.) with the antibodies twice a week alone or in combination with anti-PD1 (Bio X Cell). Tumor volume will be measured daily.

Similarly, EO771 breast medullary adenocarcinoma cells are implanted into the mammary fat pad, and tumor size will be monitored following antagonist antibody treatment over time. A variety of other tumor cell lines, such B6-F10 melanoma, or LLC Lewis lung carcinoma can be used for the same purpose.

A spontaneous HCC tumor model based on a transposon system expressing C-Myc and a CRISPR-Cas9 system expressing a sgRNA targeting Trp53 specifically being delivered to hepatocytes via hydrodynamic tail vein (HDTV) injection is studied. 3-5 weeks after HDTV, spontaneous HCC tumors derived from C-Myc overexpression (C-MycOE) and Trp53 deletion (Trp53KO) develop in these mice. Antagonistic anti-hetero-EPOR and neutralizing, anti-EPO antibodies (neutralizing for activity with the hetero-EPOR) are administered. Luciferase co-expressing transposons are utilized to monitor spontaneous HCC growth with antibody treatment over time.

A preclinical model of liver metastasis, as established by s.c. or intrahepatic inoculation of MC38 colon tumor cells, is used to verify the liver metastasis-induced systemic tolerance inhibiting effects of antagonistic anti-hetero-EPOR antibodies, and neutralizing anti-EPO antibodies (neutralizing for activity of the hetero-EPOR). Since there is a complete abrogation of therapeutic response to anti-PD-L1 in mice bearing both s.c. implanted MC38 and liver tumors, anti-PD-L1 responsiveness is used as a readout for the tolerance abrogating efficacy of those antibodies.

Other genetically engineered pre-clinical spontaneous tumor models, such as melanoma (BRAF$^{V600E}$ mutant mice), breast cancer (MMTV-PyMT mice), lung cancer (Kras$^{LSL-G12D/+}$;p53$^{fl/fl}$ mice) are also used to test the efficacy of therapeutic antagonist antibodies.

Example 15. Characterization of the Immunosuppressive Roles of the Agonistic Anti-Hetero-EPOR Antibody in an In Vivo Transplantation Model Agonistic antibodies specific to the hetero-EPOR are tested similarly as described in Example 9.

Example 16. Induction of Antigen Specific Tolerance In Vivo with the Agonistic Anti-Hetero-EPOR Antibody Agonistic antibodies specific to the hetero-EPOR are tested similarly as described in Example 10.

Example 17. Induction of Antigen Specific Tolerance In Vivo with PHD Inhibitors PHD inhibitors, e.g., roxadustat, vadadustat, daprodustat, and molidustat, lead to elevation of HIF levels and upregulation of EPO and EPOR, and are tested similarly as described in Example 10.

Example 18. Induction of Immune Tolerogenic Effect by EPOR

Figure 18A:
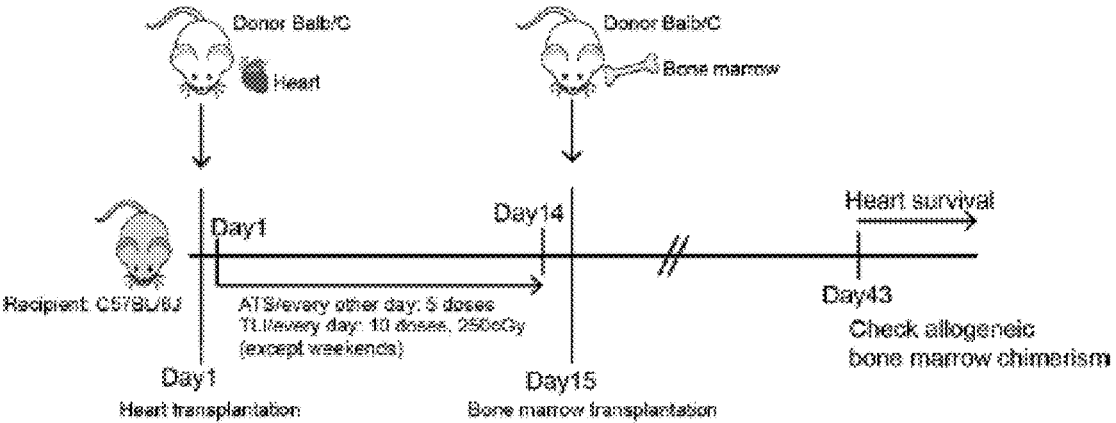
FIGS. 18A-18B illustrate TLI/ATS-induced tolerance to allogeneic (allo) bone marrow (BM) and heart transplants.
Figure 18B:
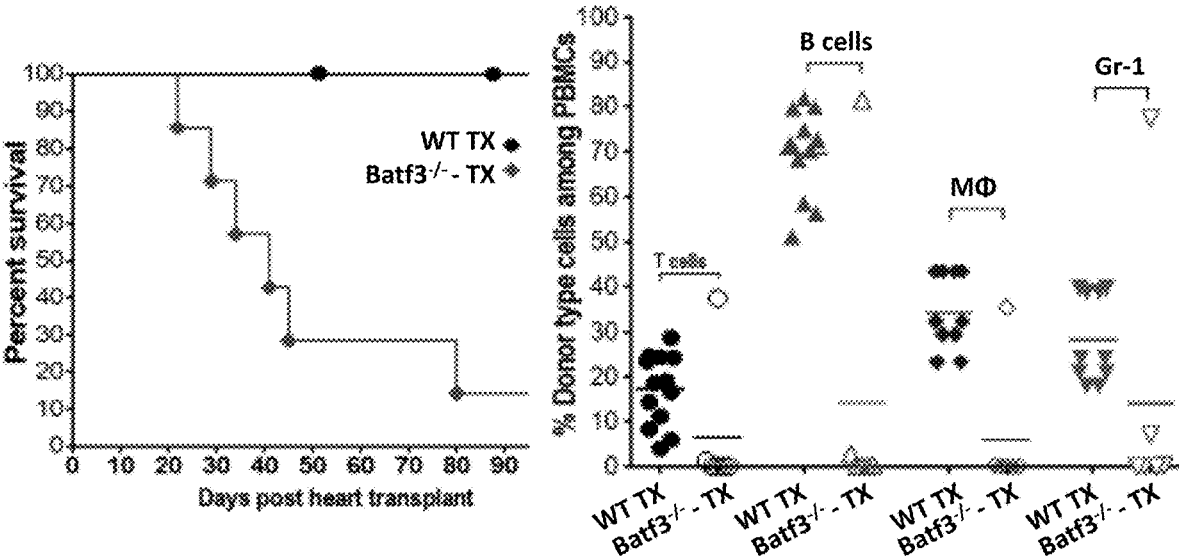
Figures 20D, 20E:
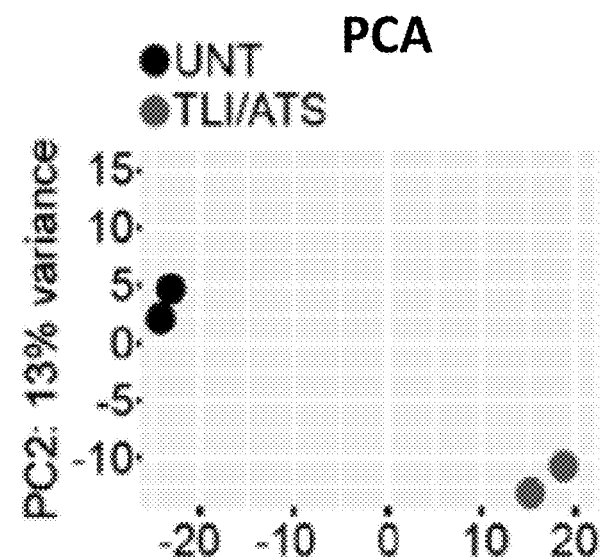
Figure 20F:
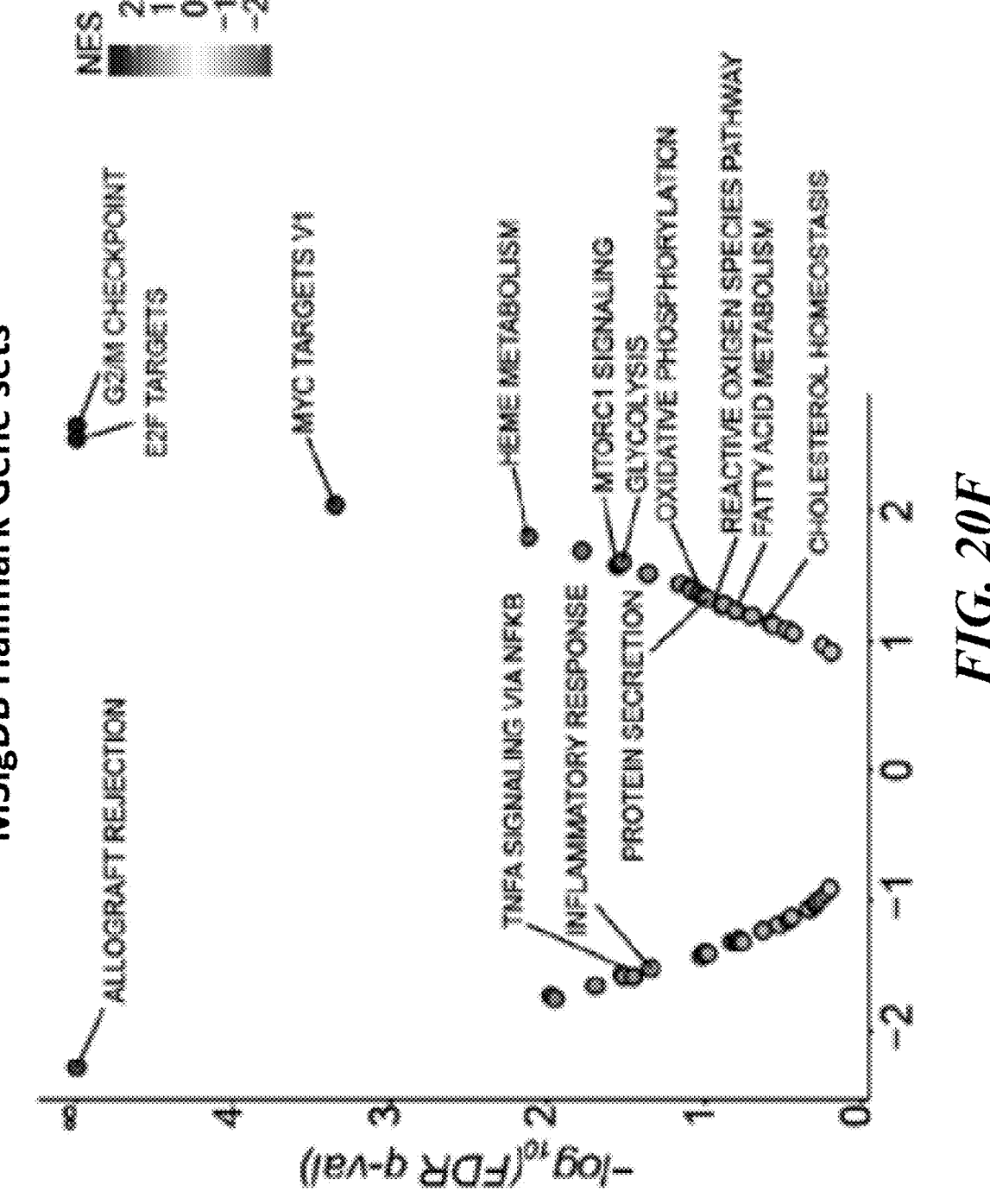
Figure 20G:
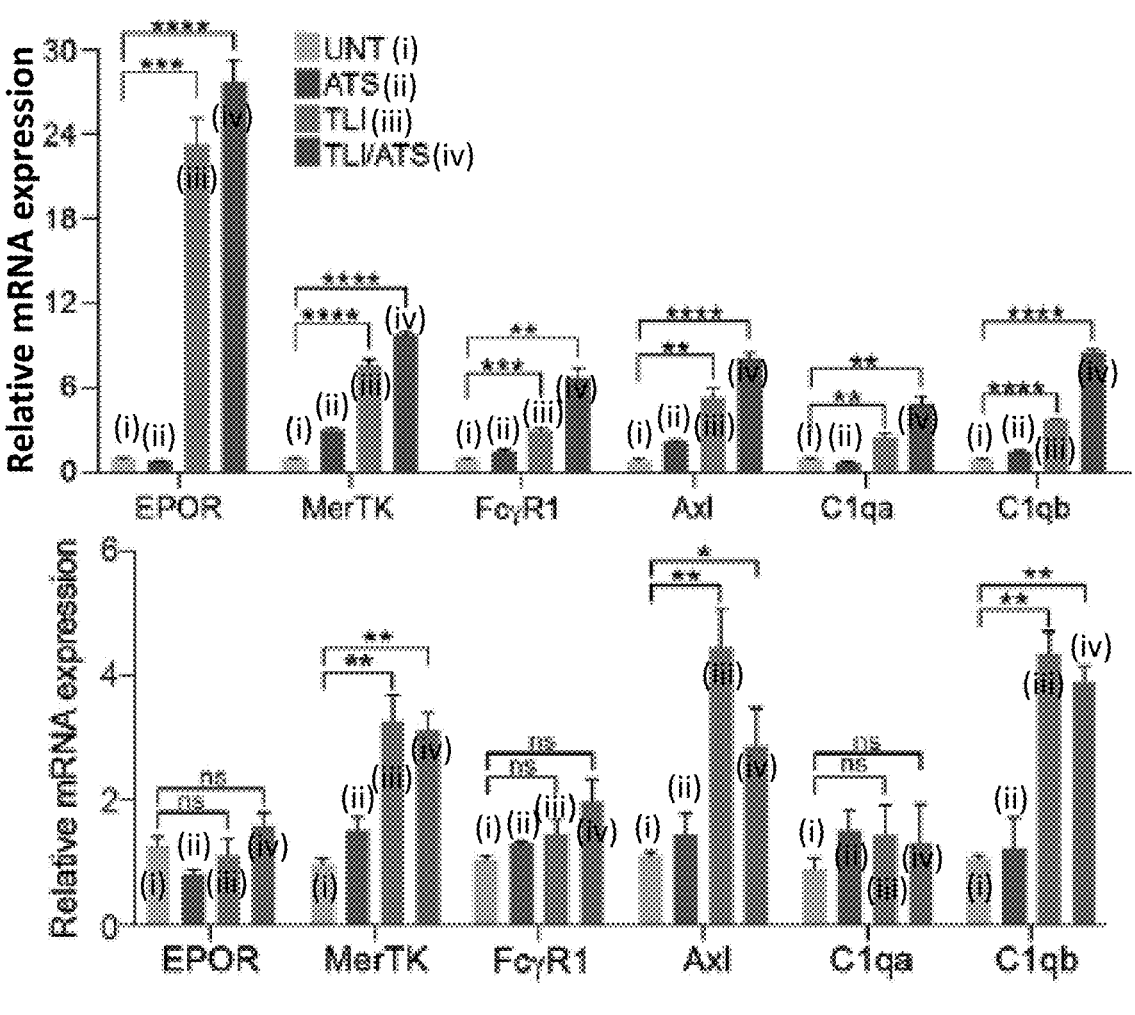
Figure 20H:
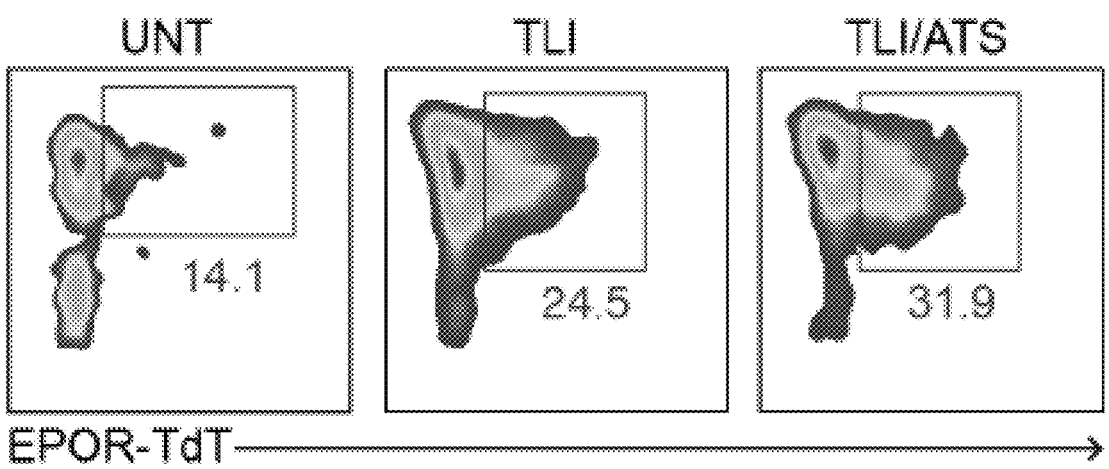

TLI/ATS-Induced Tolerance to Allogeneic (Allo) Bone Marrow and Heart Transplants C57BL/6 mice were treated with 10 doses of Total lymphoid irradiation (TLI; 250 centigray (cGy) each) with 5 doses of Anti-thymocyte serum (ATS) as tolerance-inducing regimen). Radiation was targeted to the lymph nodes, spleen, and thymus, and other tissues were shielded with lead. Bone marrow (BM) cells ($50\times10^6$) from BALB/c donors were injected intravenously (i.v.) after the last TLI dose. Hearts from BALB/c donors were transplanted on day 0. Experimental scheme is shown in FIG. 18A. Recipient mice were conditioned with TLI/ATS to induce sustained antigen (Ag)-specific tolerance to both allogeneic (allo) hematopoietic cell transplant (HCT) and solid organ allografts (FIG. 18A). Long-term tolerance in this model can be dependent upon several cell types, including regulatory T cells (Tregs), natural killer T (NKT) cells, and myeloid-derived suppressor cells. In addition, CD8α$^+$ type I conventional dendritic cells (cDC1s) were found to be indispensable for TLI/ATS tolerance induction (FIG. 18B), as grafts were rejected in mice lacking Batf3 (Batf3$^{-/-}$), a transcription factor necessary for cDC1 development, compared to wildtype (WT) mice. For example, as shown in FIG. 18B, less Batf3$^{-/-}$ mice survived post heart transplant (TX) than WT, and exhibited decreased percentage of donor type cells than WT. TLI/ATS induced profound depletion of T cells and B cells in lymphoid organs (FIGS. 19A-19B) through p53-dependent apoptosis, as indicated by increased TUNEL staining (FIG. 19A) in spleen of mice with TLI/ATS compared to untreated (UNT) mice. A high level of extramedullary erythropoiesis, as measured by percentage of CD71 and TER119 expression via flow cytometry, was observed in mice with TLI compared to UNT mice (FIGS. 19B-19C). TLI also increased percentage of CD71+ and TER119+ (FIG. 19D) and increased EPO levels in blood serum (FIG. 19E), as detected by enzyme-linked immunoassay (ELISA) assay, in mice treated with TLI over a course of time. Since CD8α$^+$ cDC1s preferentially take up apoptotic cells, and EPO levels are increased, the data suggested that EPO-EPOR signaling may be involved in CD8α$^+$ cDC1-mediated tolerance following TLI/ATS. Thus, CD8α$^+$ cDC1s were further analyzed from TLI/ATS conditioned mice and UNT mice. Relative to UNT mice, conditioning with TLI/ATS decreased the total number of splenic cells (FIG. 20A) but increased the frequency of cDCs, defined as CD11c$^{high}$MHCII$^{high}$cells (1.5% in UNT versus 3.01% TLI/ATS), as shown in FIG. 20B. Moreover, the proportion of CD8α$^+$ expressing cDC1s (25.2%, CD8α$^+$CD11b$^-$) but not CD11b$^+$ expressing type II conventional dendric cells (cDC2s) (59.5%, CD11b$^+$ CD8α$^-$) increased upon conditioning with TLI/ATS (FIG. 20C). To identify gene expression changes associated with TLI/ATS conditioning in the CD8α$^+$cDC1 subset, RNAs from this subset of cells isolated from spleens of UNTor TLI/AT conditioned mice were subjected to RNA-sequencing. Transcriptomes derived from splenic CD8α$^+$cDC1s in TLI/ATS conditioned versus UNT control mice clustered distinctly by principal components analysis (PCA) (FIG. 20D), showing difference in gene expression in TLI/ATS conditioned versus UNT control mice. In addition, a comparison of the 30 most upregulated genes in CD8α$^+$ cDC1s from the TLI/ATS-conditioned vs. the UNT mice revealed that the erythropoietin receptor (EPOR) was the most differentially upregulated gene (FIG. 20E). Furthermore, Molecular Signatures Database (MSigDB) analysis confirmed that gene sets involved in diverse aspect of cell metabolism were positively enriched, while those involved in allograft rejection, TNFα signaling via NFκB, and inflammatory responses were negatively enriched in CD8α$^+$ cDC1s upon conditioning with TLI/ATS (FIG. 20F). Real-time PCR was performed on selected genes, identified by RNAseq data shown in FIG. 20E, in splenic CD8α$^+$ cDC1s and CD11b$^+$ cCD2s (FIG. 20G) and showed that EPOR expression was upregulated in cDC1s (FIG. 20G, top), confirming the RNA-sequencing data. Specifically, EPOR expression in CD8α$^+$ cDC1s was increased more than 20-fold with (iii) TLI alone or (iv) with TLI/ATS compared to (i) UNT, and (ii) ATS alone had little or no effect compared to (i) UNT (FIG. 20G). Similar patterns were observed for MerTK, FcγR1, Ax1, C1qa, and C1qb (FIG. 20G, top). In contrast, expression of EPOR did not increase in CD11b$^+$ cDC2s (FIG. 20G, bottom). EPOR expression was also assessed by using EPOR-tdT report mice (FIG. 20H), treated with TLI, TLI/ATS or untreated. A selective increase in the frequency of EPOR$^+$ CD8α$^+$ cDC1s following TLI (24.5%) was observed compared to UNT mice (14.1%) and this was augmented by ATS (31.9%) (FIG. 20H). Collectively, conditioning with TLI/ATS or TLI substantially altered the frequency of CD8α⁺ DC1s and induced the expression of EPOR and related genes within this subset.

Immune Tolerogenic Phenotype in EPOR+ DCs

Figure 1:
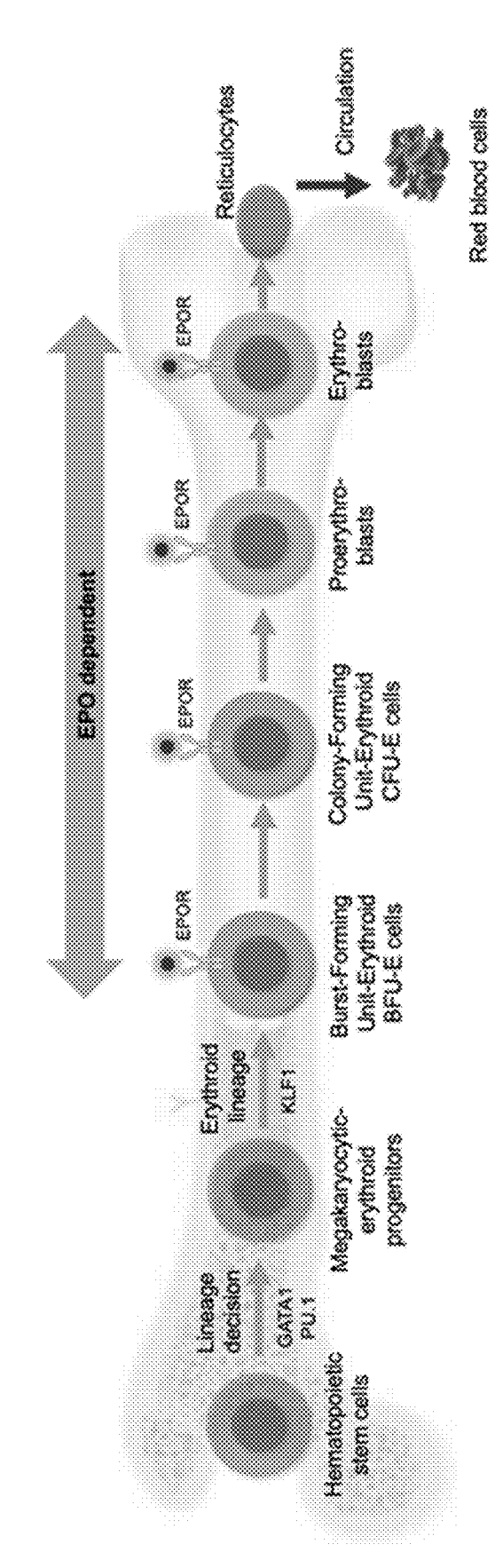
FIG. 1 is an overview of erythropoiesis mediated by EPO and the homo-EPOR in erythroid progenitor cells.
Figure 3A:
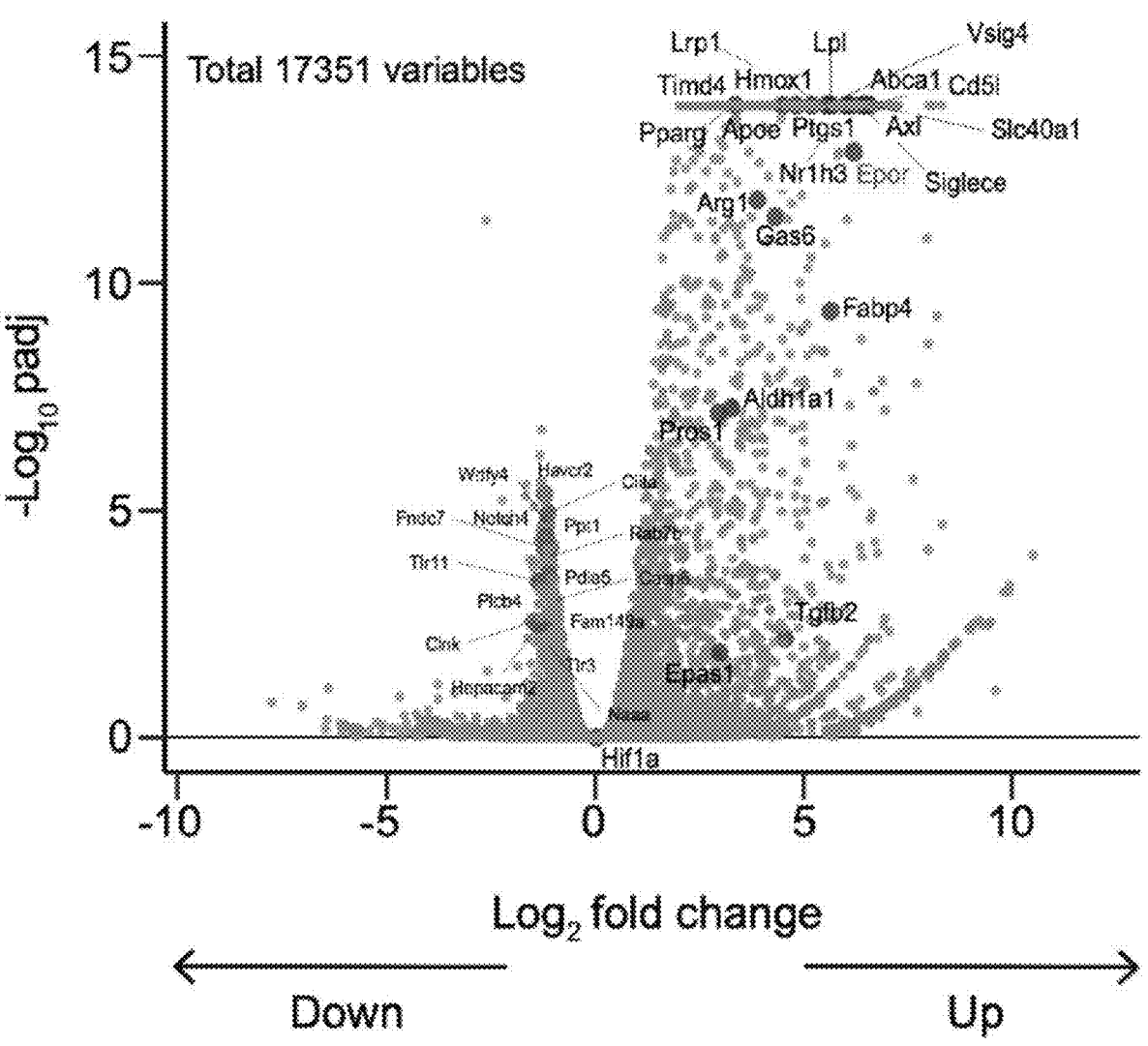
FIGS. 3A-3B illustrate gene expression analysis of genes in EpoR$^+$ (EpoR$^+$) vs. EpoR$^-$ (EpoR$^-$).
Figure 3B:
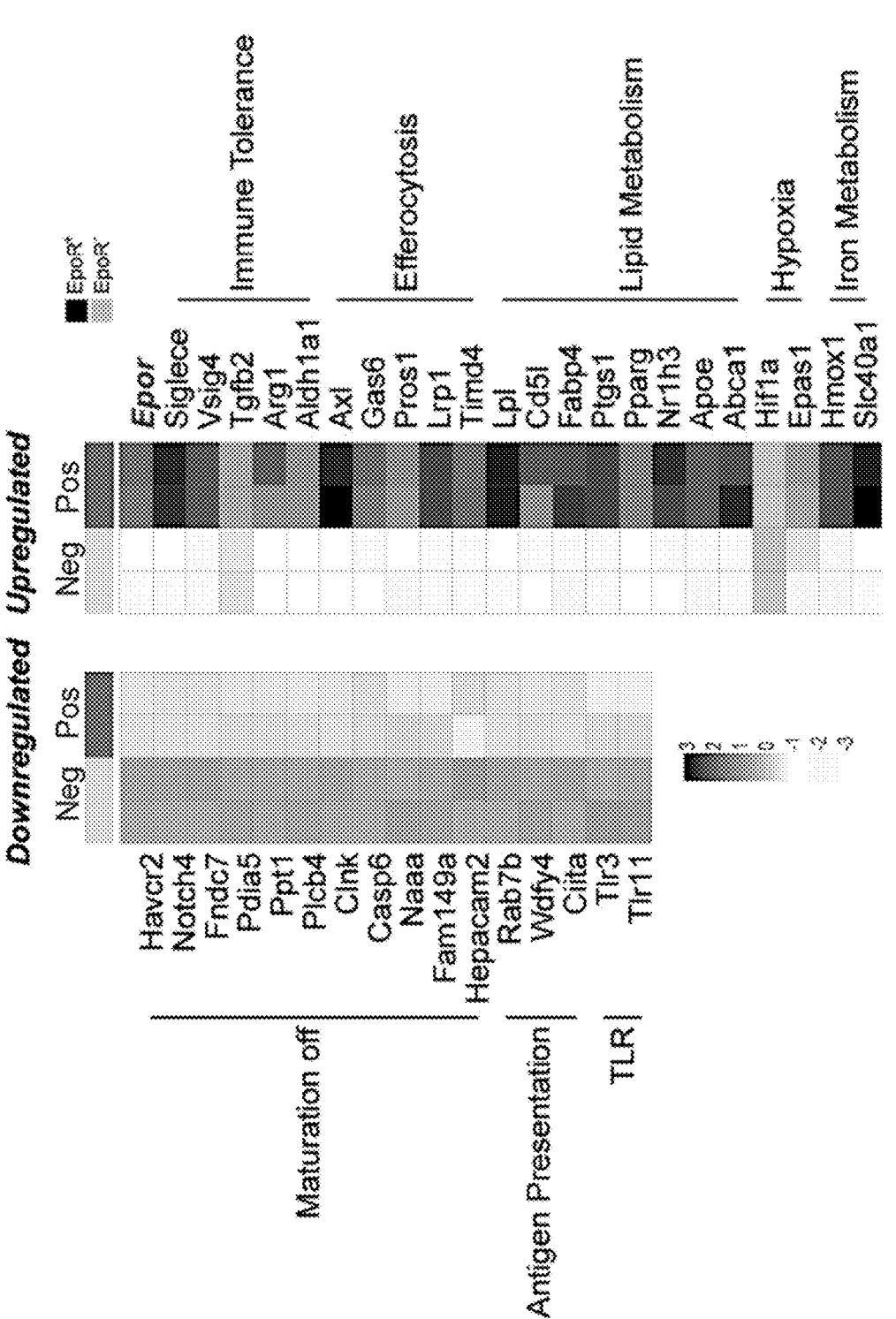

To understand whether EPOR signaling plays a role in immune-modulatory function on immune cells, RNA-sequencing was performed on EpoR⁺ and EpoR⁻ XCR1⁺ CD8α⁺CD11c$^{high}$MHCII$^{high}$ cDC1s (XCR1: XC-Chemokine Receptor 1). EpoR⁺ and EpoR⁻ cDC1s from the spleen of EpoR-tdTomato reporter mice (n=2, each pooled from 15 mice) were first sorted by flow cytometry before subjecting EpoR⁺ and EpoR⁻ cDC1s to RNA-sequencing. Next, gene differential expression analysis was performed with the RNA-sequencing data using DESeq2 based on R programming. Differential expression analysis was represented as a volcano plot, and it revealed differentially expressed genes that were downregulated (left half of the graph) and upregulated (right half of the graph) in EpoR⁺ cDC1s compared to EpoR⁻ cDC1s (see FIG. 3A). A heat map was generated using DESeq2 as an alternative way to represent upregulated and downregulated genes in EpoR⁺ and EpoR⁻ cDC1s, as shown in FIG. 3B. Heat map revealed genes of interest grouped into tolerogenic functional groups, showing that genes associated with immune tolerance is upregulated in EpoR⁺ cDC1s.

EPOR in BM Chimerism

Figure 21:
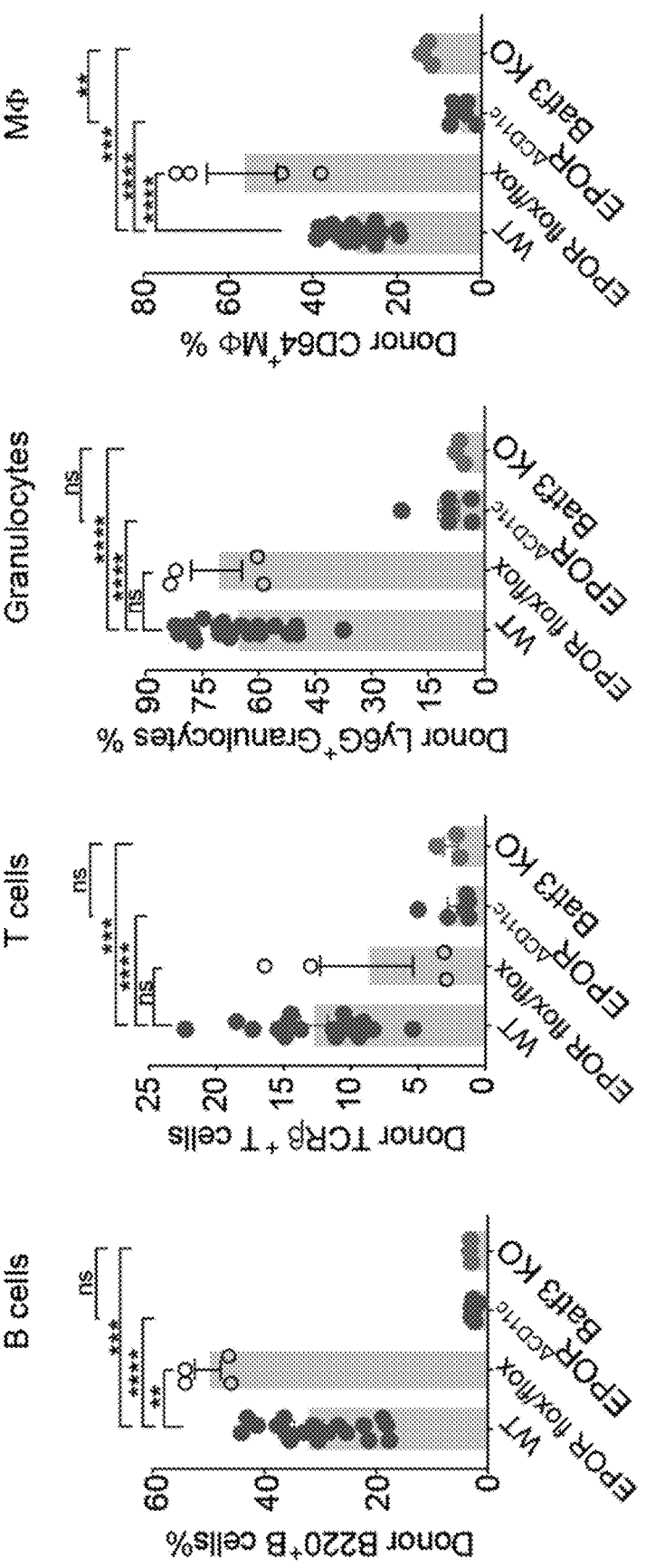
FIG. 21 shows TLI-ATS-induced chimerism in wild type (WT), EPOR flox/flox mice, mice with dendritic cell (DC)-specific hetero-EPOR gene deletion (EPOR$^{\Delta CD11c}$), and Batf3 knock out (KO) mice in B cells, T cells, granulocytes, and macrophages (MΦ). Percentages of donor type cells among T cells (TCRβ$^+$), B cells (B220$^+$), and granulocytes (Ly6G$^+$) in the blood of hosts 14 days after BM transplant. Bars show the mean percentages of donor cells. P values by the 2-tailed t-test of independent means. *P<05; P<01; *P<001; ns, no significant differences.

To investigate EPOR's immune tolerogenic phenotype, BM chimerism was analyzed in mice with hetero-EPOR deletion in CD8α⁺ dendritic cells (EPOR$^{ΔCD11c}$ mice). EPOR$^{ΔCD11c}$ (CD11$^{cre+}$; EPORW$^{flox/flox}$) mice were generated by breeding mice bearing floxed EPOR with a CD11c-Cre strain, EPOR$^{ΔCD11c}$ (CD11$^{cre+}$; EPOR$^{floxed(flox/flox)}$). EPOR$^{ΔCD11c}$(H-2b⁺) recipient mice were given BM from MHC-mismatched BALB/c (H-2d⁺) donors. Wild-type C57BL/6 (WT), Batf3⁻/⁻ and EPOR$^{flox/flox}$ mice on the C57BL/6 background (H-2b⁺) were used as control recipients. Allogeneic BM cells were infused immediately after the last dose of TLI, and chimerism was assessed as early as day 14 thereafter. As shown in FIG. 21, EPOR$^{flox/flox}$ mice displayed similar levels of BM chimerism in B cells, T cells, and granulocytes as WT mice. In contrast, and similar to Batf3⁻/⁻ mice, EPOR$^{ΔCD11c}$ mice failed to achieve BM chimerism, as shown by the decreased percentage of donor B cells, T cells and granulocytes. Importantly, CD8α⁺ cDC1-specific EPOR expression was found to be indispensable for BM chimerism and tolerance induction, as reflected by the abrogation of chimerism when EPOR expression was abolished in these cells. Collectively, these data demonstrate that EPOR-expressing cDC1s are tolerogenic. They also support the use of TLI/AT-induced tolerance as an ideal model to investigate the role of EPO-EPOR signaling-dependent tolerogenic CD8α⁺ cDC1s in cell-associated Ag-specific tolerance.

Figure 22A:
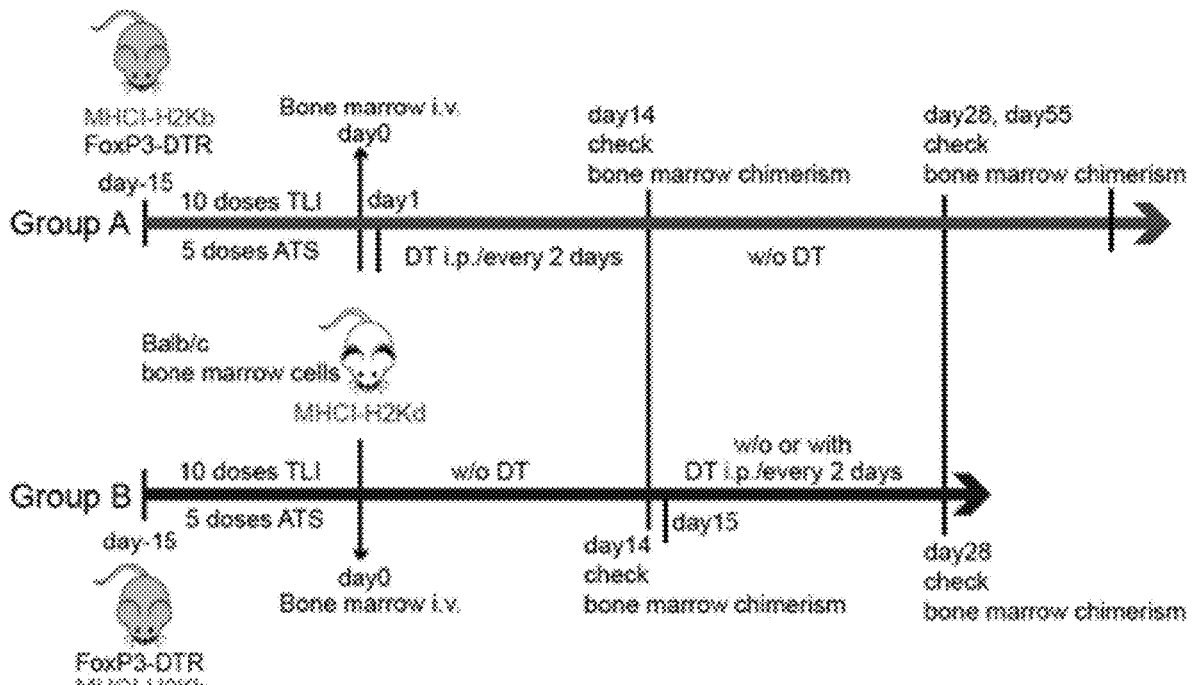
FIGS. 22A-22B show abrogation of both bone marrow chimerism establishment and maintenance by administration of diphtheria toxin (DT) administration to FoxP3-DTR (forkhead box P3-diphtheria toxin receptor) recipient mice.
Figure 22B:
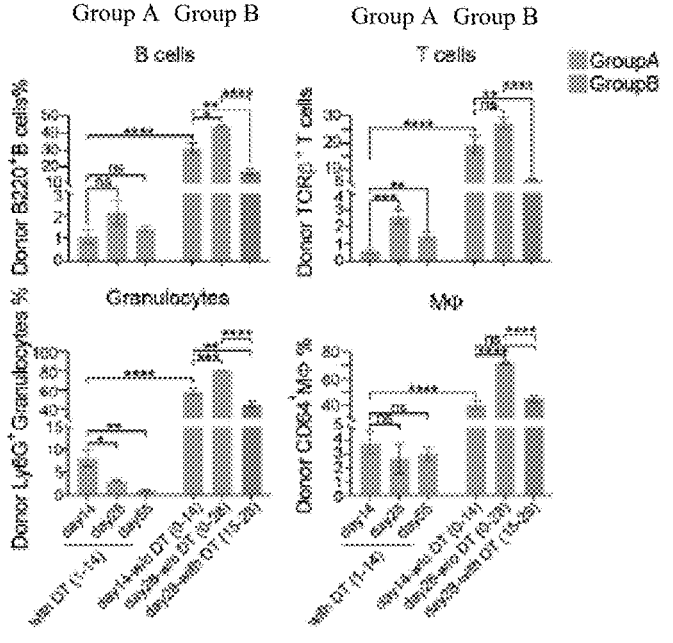

Next, whether CD4⁺ FoxP3⁺ Tregs are activated and expanded by CD8α⁺ cDC1s following TLI or TLI/ATS, and whether the extent of allo-BM "loading" from the transplant is an important factor in the establishment of mixed chimerism (engraftment) were tested. To examine the relative importance of FoxP3⁺ Tregs in the induction and maintenance of immune tolerance to allo-BM cells, diphtheria toxin (DT) and the FoxP3-DTR system was used to deplete FoxP3⁺ Tregs in recipient mice during different time windows following allo-BM injection, from day 0 to 14 (Group A, top) or day 29 to 41 (Group B, bottom), respectively, as shown in FIG. 22A. Briefly, FoxP3-DTR recipient mice were either untreated (UNT) or treated with 10 daily doses of TLI (240cGy each) and ATS (5 doses, every other day) for 14 days except weekends (TLI/ATS). On day 0, BM cells from allo-donors (MHCI-H2Kb) were injected intravenously (i.v.) and chimerism was monitored by blood sampling starting on day 14 (FIG. 22A). Group A (left 3 bars in all 4 graphs), which started DT treatment (Tx) on day 1 after BM injection, did not have any detectable chimerism detectable on day 14, day 28, or day 55, as shown in FIG. 22B. In contrast, similar to wild-type mice (FIG. 21), chimerism was detected on day 14 in Group B mice (right 3 bars in all 4 graphs) and continued to increase through day 28 in the absence of (w/o) DT. However, when DT was administered from day 15 to day 28, there was no further increase and instead, a decline of the already established chimerism was observed (FIG. 22B). These data validated the importance of CD4⁺ FoxP3⁺ Tregs in the establishment and maintenance of chimerism after allo-BM encounter.

Figure 23A:
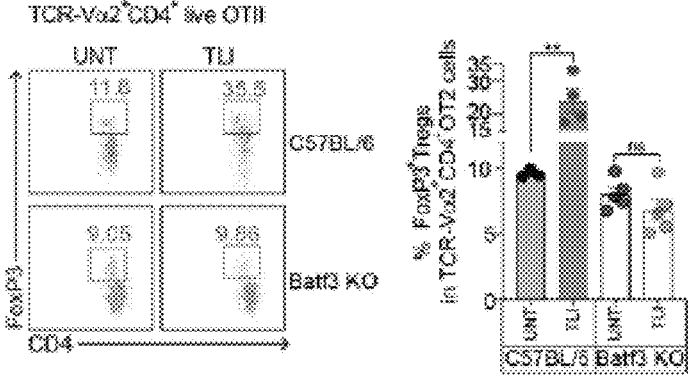
FIGS. 23A-23D show requirement of CD8α$^+$ cDC1 for Antigen-specific CD4$^+$ FoxP3$^+$ Treg induction and expansion. C57BL/6 (Wildtype) or Batf3$^{-/-}$ mice, or EPOR$^{\Delta CD11c}$ recipient mice were either untreated (UNT) or TLI-conditioned. Macrophages negatively selected OT-II cells (cells expressing ovalbumin (Ova) specific αβTCRs) were injected intravenously (i.v.) 1 day after the last dose of TLI, and Ova-expressing bone marrow cells were injected i.v. after another day. After 5 days, FoxP3 expression was examined by flow cytometry on adoptively transferred OT-II cells defined as TCR-vα2$^+$CD4$^+$.
Figure 23B:
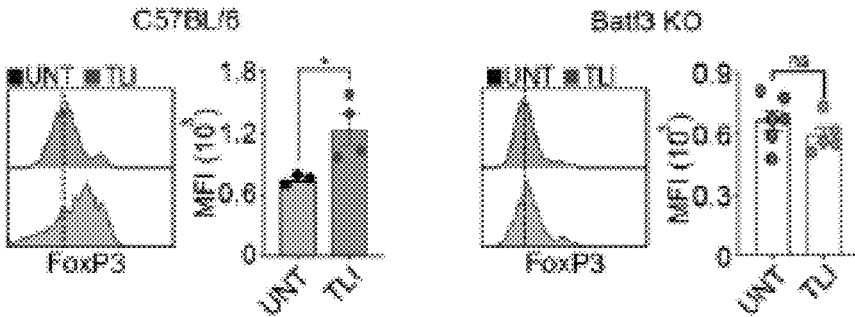
Figure 23C:
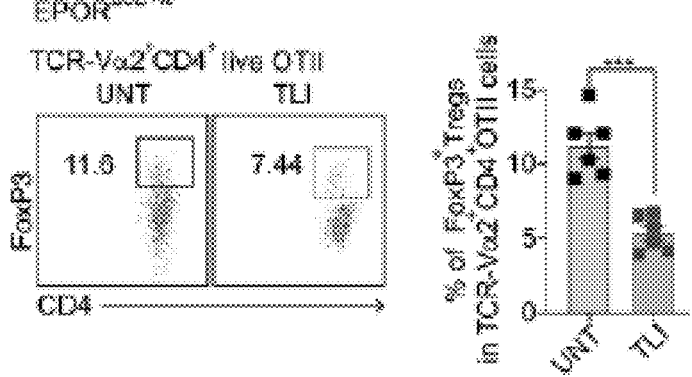
Figure 23D:
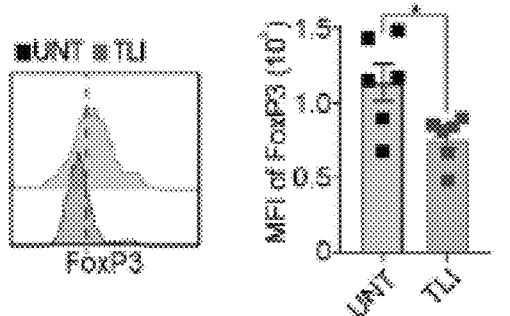

Next, to investigate CD8α⁺ cDC1-dependent Ag-specific FoxP3⁺ Treg induction and expansion and to avoid the selective effect of TLI and/or ATS on the remaining T cells, OT-II cells (cells expressing ovalbumin (Ova) specific αβTCRs) were adoptively transferred and allo-BM was substituted with Ova-expressing BM. Adoptive transfer of Ova-specific TCR transgenic OT-II T cells allowed monitoring of the Ag-specific CD4⁺ T cell response. As expected, CD4⁺ FoxP3⁺ OT-II Treg frequency (FIG. 23A) and mean fluorescence intensities (MFIs) (FIG. 23B) of FoxP3 in OT-II cells increased dramatically after 5 days in TLI-conditioned recipients compared to untreated mice. This effect was absent in Batf3⁻/⁻ (FIGS. 23A-23B) and EPOR$^{ΔCD11c}$ recipient mice (FIGS. 23C-23D), confirming that CD8α⁺ cDC1s and EPOR are indispensable for Ag-specific CD4⁺ FoxP3⁺ Treg induction and expansion. Interestingly, in TLI-conditioned EPOR$^{ΔCD11c}$ recipient mice, both Foxp3⁺ OT-II percentage and FoxP3 MFI in OT-II cells were decreased compared to UNT (FIGS. 23C-23D). FoxP3-DTR mice were treated with TLI/ATS for 14 days. Allogeneic Balb/C bone marrow cells were infused i.v. immediately on the next day after TLI/ATS treatment (Day 0). 100ng Diphtheria toxin (DT) was given i.p. on day −1, day 0, and day 1. As shown in FIG. 24A, Bone marrow chimerism was analyzed by donor derived individual immune cell subset in the host blood with or without DT. As shown in FIG. 24B, host CD4⁺ T cells were analyzed by flow cytometry on day 5, and percentages of FoxP3+ Tregs, and FoxP3-CD73+FR4+ anergic T cells were quantified. IFNg expression was seen in host CD4+FoxP3− T cells. As shown in FIG. 24C, statistical analysis of the frequency of host CD4+ T cells, FoxP3+ Treg cells in host CD4⁺ T cells, FoxP3-CD73+FR4+ anergic cells in host CD4+ T cells, and IFNg+ cells in host CD4+FoxP3− cells were performed. As shown in FIG. 24D, correlation of FoxP3+ Treg cells frequency in host CD4+ T cells with FoxP3-FR4+CD73+ anergic cells in host CD4+ T cells was analyzed. Deletion of CD4⁺ FoxP3⁺ Tregs with DT led to the anergic reversal of CD4⁺ FoxP3⁻CD44⁺ CD73⁺ folate receptor 4+ (FR4⁺) anergic T cells, and an uncontrolled CD4+FoxP3⁻ T cell immune response, as indicated by a marked expansion of interferon gamma (IFNγ⁺) effector T cells, suggesting tolerance escape (FIGS. 24A-24D). It was further observed that TLI conditioning imprinted dynamic expansion and activation of recipient CD4⁺ FoxP3⁺ Tregs in response to allo-BM, which was dependent on CD8α cDC1s. Taken together, these data suggest that EPO signaling contributes to Ag-specific tolerance induction and maintenance, primarily through upregulated EPOR expression on CD8α⁺ cDC1s, which induce both regulatory and anergic Ag-specific CD4⁺ T cells.

Characterization of the Tolerogenic Phenotype, Function and Cellular Tolerance of EPOR+cDC1s Before and After TLI/AT To confirm EPOR$^+$ cDCs after TLI conditioning preferentially take up i.v. injected allogeneic BM cells, live Balb/C BM cells were labeled with a fluorescent dye, 5-chloromethylfluorescein diacetate (CMFDA), and injected i.v. into wild-type C57BL/6J mice. Compared to CD8$\alpha^-$ cDC2s, CD8$\alpha^+$ cDC1s preferentially took up i.v. injected live BM cells, with TLI conditioning further increasing uptake (FIG. 25A). CD8$\alpha^+$ cDC1s from TLI-conditioned mice displayed greater engulfment after 12 hour compared to UNT mice (FIGS. 25B-25C). CD103 and DEC-205, which are markers for cDC1s, co-staining revealed that CD8$\alpha^+$ cDC1s, which preferentially took up more allogeneic BM cells, had higher expression of both markers (FIGS. 25A-25C). EPOR-tdT and EPOR$^{ACD11c}$ mice can be further utilized to assess whether the EPOR expression correlates with CMFDA$^+$ allogeneic BM uptake in CD8$\alpha^+$ cDC1s.

Identification of cDC1-Specific EPO-EPOR Signaling Events Downstream of TLI/AT

To verify EPO-EPOR signaling in CD8$\alpha^+$ cDC1s following TLI, phosphorylation of Akt, ERK, and STAT5 was measured by flow cytometry. In parallel with EPOR upregulation (FIG. 20), phosphorylation of all of these molecules was also upregulated following TLI (FIG. 26). These data confirm downstream EPOR signaling pathways in CD8$\alpha^+$ cDC1s following TLI. PI3K-Akt are important for running mTOR pathway and as expected, following TLI, CD8$\alpha^+$ cDC1s displayed higher activation of mTOR, indicated by phosphorylation of downstream effector ribosomal protein S6 kinases (S6Ks) and activation of the translation inhibitor eIF4E-binding proteins (4E-BPs), as shown in FIG. 26A. Furthermore, adding ATS further enhanced 4EBP1 phosphorylation (FIG. 26). CD8$\alpha^+$ cDC1s were also more metabolically active and had greater mTORC1 activity than CD11b$^+$ cDC2s, which could be further enhanced by TLI conditioning (FIG. 26). This finding suggests that EPO signaling can be critical for tuning mTOR activity selectively in CD8$\alpha^+$ cDC1s following TLI or TLI/ATS. In this regard, CD11c-specific Raptor and mTOR conditional knock out mice have been generated to investigate their tolerogenic involvement in EPOR$^+$ cDC1s, as shown by the measurement of donor cells of the different mouse strains in FIG. 26B. The metabolic activity of EPOR$^+$ and EPOR$^-$ cDC1s using a Seahorse instrument that measures oxygen consumption rate and extracellular acidification rate in a multi-well format can be analyzed and this will enable interrogation of key cellular functions such as mitochondrial respiration and glycolysis. In addition, the relationship of these findings to EPOR+ cDC1 tolerogenic function can be analyzed.

EPOR in BM Chimerism and Tolerance to Organ Transplant

Figures 4A, 4B, 4C:
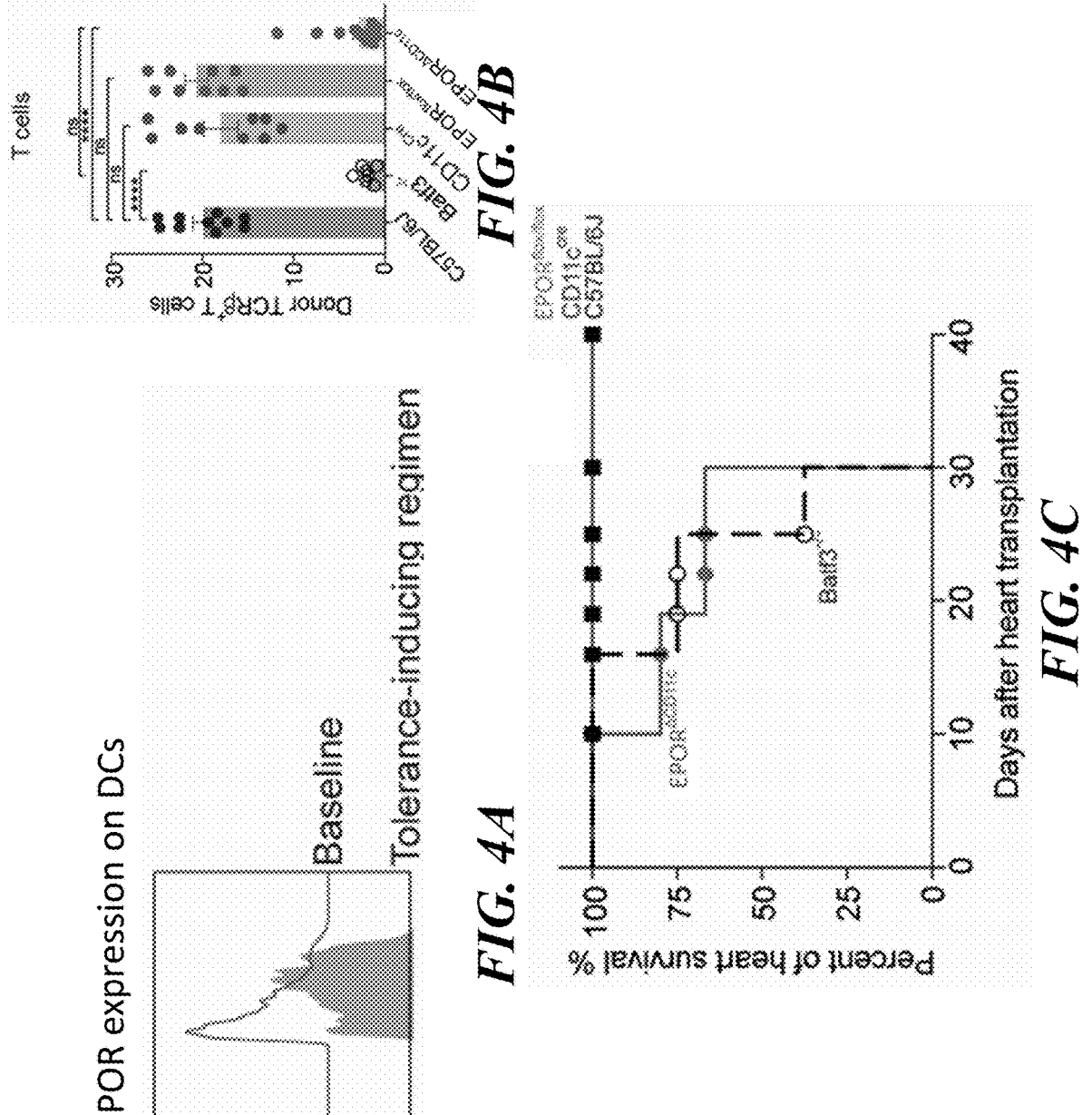
FIGS. 4A-4C illustrate the effect of hetero-EPOR knockout in dendritic cells (DCs).

To investigate EPOR's immune tolerogenic phenotype and its effect in organ transplant, heart transplantation was performed with mice with hetero-EPOR knockout in myeloid cells. Host mice, such as wild-type mice (C57Bl/6J), Batf3 knockout mice (Batf3$^{-/-}$), mice with CD11c$^{Cre}$ (CD11c$^{Cre}$), mice with EPOR$^{flox/flox}$ (EPOR$^{flox/flox}$) and mice with knockout of hetero-EPOR in dendritic cells (EPOR$^{ACD11c}$) were given donor BALB/c neonatal heart transplants on day 0. ATS was injected intraperitoneally (i.p.) in the mice on days 0, 2, 6, 8, and 10. Host mice were conditioned over 14 days with 10 doses of TLI of 240 cGy each. As shown in FIG. 4A, EpoR$^-$ tdTomato expression in EpoR-tdTomato hosts was analyzed by flow cytometry on the XCR1$^+$CD8$\alpha^+$ cDC1s in the spleen on the next day of the last dose of TLI/ATS (Tolerance-inducing regimen) compared with untreated (baseline) mice. Flow cytometry revealed that with tolerance-inducing regiment, there is increased expression of EPOR in cDC1s, confirming EPOR's immune tolerogenic phenotype. On day 15, bone marrow transplantation was performed (BMT) by injecting 50×10$^6$ host or BALB/c donor bone marrow cells from the same strain as the heart grafts via i.v. Chimerism and heart graft survival were monitored for 100 days after organ transplantation. As shown in FIG. 4B, percentages of donor type (H2K$^{d+}$) cells (e.g., marker of Balb/C MHCI) among T cells in the peripheral blood of hosts 28 days after BMT was measured. In EPOR$^{ACD11c}$ mice, there was a statistically significant decrease in donor T cells compared to C57Bl/6J, with no difference between positive control Batf3$^{-/-}$ mice, suggesting that EPOR is necessary for immunogenic tolerance. Furthermore, when the percentage of hosts with heart graft survival was measured at serial time points (see FIG. 4C), EPOR$^{ACD11c}$ mice were not able to survive post heart transplantation, similar to what was seen with positive control Batf3$^{-/-}$ mice, compared to negative control mice (e.g., C57Bl/6J, CD11c$^{Cre}$ EPOR$^{flox/flox}$). This showed that EPOR knockout from myeloid cells prevented tolerance to transplanted organs in mice.

EPOR Signaling in Stimulation of Ag-Specific Tregs In Vitro and In Vivo

Figure 5A:
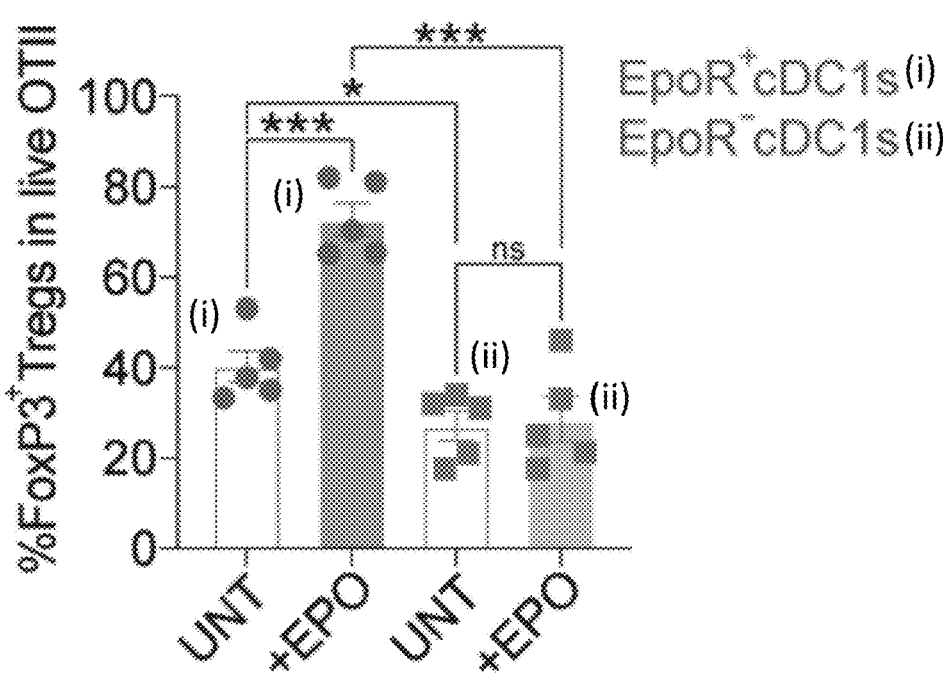
FIGS. 5A-5B illustrate Antigen (Ag)-specific Regulatory T-cells (Treg) induction by EPOR in dendritic cells (cDC1s).

To investigate EPOR function in promoting antigen-specific tolerance, EpoR-tdTomato mice were given ATS i.p. on days 0, 2, 6, 8 and 10, and conditioned over 14 days with 10 doses of TLI (240 cGy) each. EPOR+ and EPOR$^-$ XCR1$^+$CD8$\alpha^+$ CD11c$^{high}$MHCII$^{high}$ cDC1s were sorted by flow cytometry on the next day of the last dose of TLI/ATS and co-cultured with naïve OT-II cells isolated from OT-II$^{CD45.1/CD45.1}$ mice in the presence of 15 gray irradiated Ova-expressing thymocytes. The ratio of DC: OT-II: Ova-thymocytes was 1:5:2. No or 20 IU/200 µl recombinant human EPO (rhEPO) was added to the co-culture every day for 6 continuous days. FoxP3 expression on OT-II cells was analyzed by flow cytometry, and OT-II cells were gated as live-dead aqua-CD45.1$^+$CD45.2$^-$CD3$^+$ TCRv$\alpha$2$^+$CD4$^+$ CD8$^-$. OT-II cells were prelabeled with a fluorescent dye (CellTrace™ Violet) before being put into the co-culture. The percentage of FoxP3$^+$ Tregs was higher in (i) EPOR+ cDC1s compared to (ii) EPOR$^-$ cDC1s as shown in FIG. 5A.

Figure 5B:
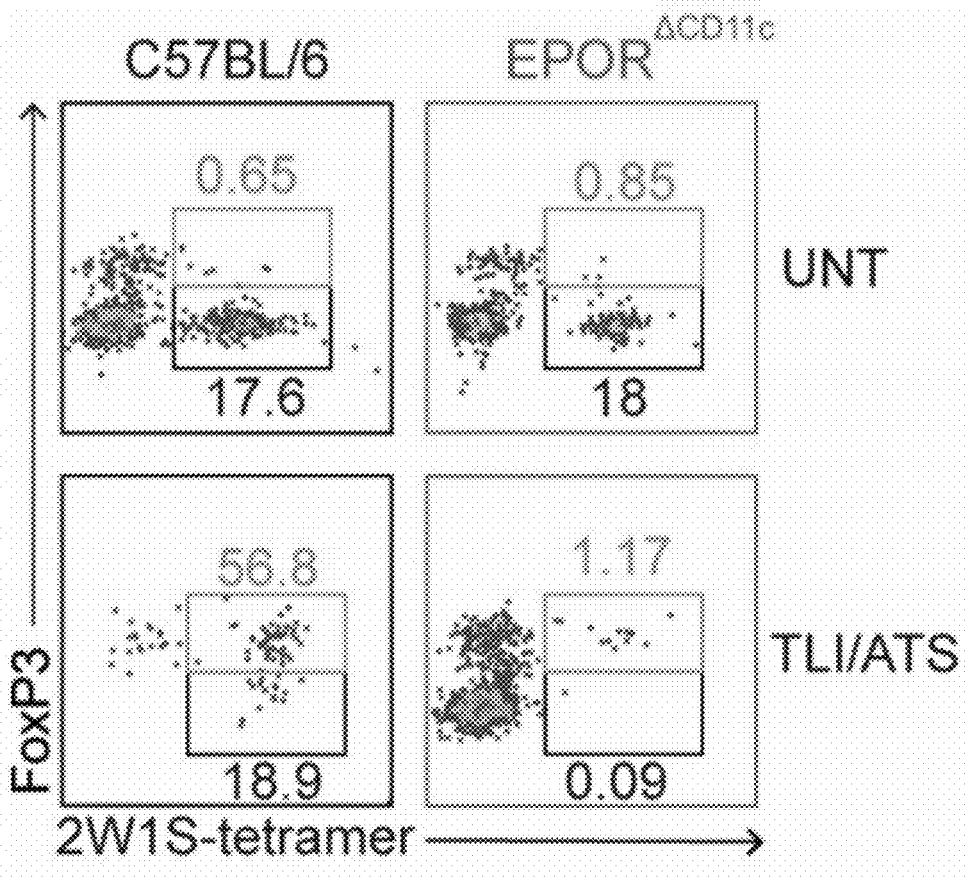

In another experiment, C57BL/6J or EPOR$^{ACD11c}$ hosts were injected with ATS via i.p. on days 0, 2, 6, 8, and 10. Hosts were conditioned over 14 days with 10 doses of 240 cGy (TLI/ATS treatment) each or were left untreated. On day 15, 50×10$^6$ 2W1S-Balb/C donor bone marrow cells were injected i.v. 14 days after the injection, FoxP3 expression was analyzed in 2W1S tetramer$^+$ H2K$^{b+}$CD3$^+$ TCR$\beta^+$ CD4$^+$ T cells, representing endogenous 2W15S-MHCII TCR specific host CD4+ T cells, from the spleens via flow cytometry to measure the host endogenous donor Ag(2W1S)-specific CD4+T cell immune response. As shown in FIG. 5B, flow cytometry data revealed that TLI/ATS treatment in EpoR$^{ACD11c}$ hosts lead to less expression of FoxP3 (1.17%) as compared to TLI/ATS treatment in C57BL/6J (56.8%), further verifying the need for EPOR in DCs to induce Ag-specific Treg in vivo.

Example 19. Effect of EPOR Deletion on Tumor Burden

In this example, how hetero-EPOR knockout affects tumor burden was investigated, as another role of EPOR can be in regulating tumor burden.

Lewis Lung Carcinoma and Breast Adenocarcinoma

Figure 6A:
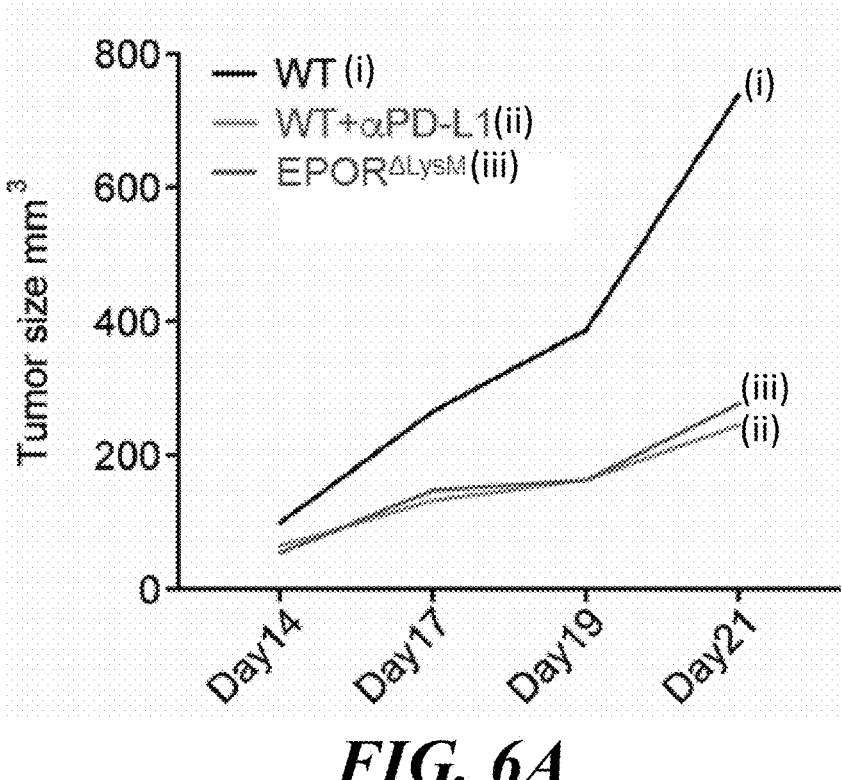
FIGS. 6A-6B illustrate tumor burden in mice with hetero-EPOR deleted from myeloid cells.
Figure 6B:
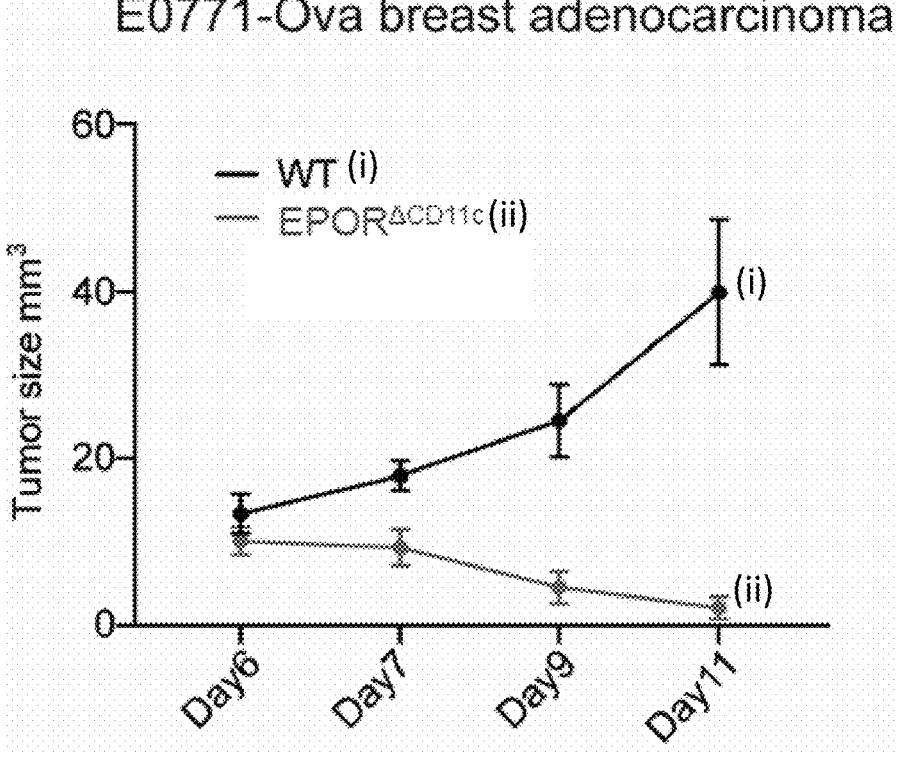

To see how EPOR affects lung carcinoma tumor burden, $5\times10^5$ lewis lung carcinoma cells (LLC) were subcutaneously implanted into wild type C57BL/6J (WT) and mice with knockout of EPOR in macrophages (EpoR$^{\Delta LysM}$) mice. 5 mg/kg of $\alpha$PD-L1 (Programmed Death-Ligand 1) (e.g., clone 10F.9G2; BioXCell) or rat IgG isotype was given intraperitoneally (i.p.) every two days starting from day 6 after tumor implantation with visible tumors. Tumor size was measured at various time points (e.g., Day 14, 17, 19, 21). As shown in FIG. 6A, the size of the tumor from (iii) EpoR$^{\Delta LysM}$ was smaller than the tumor from (i) WT mice. The tumor size of EpoR$^{\Delta LysM}$ was similar to that of (ii) wild-type mice treated with $\alpha$PD-L1 (FIG. 6A). Similarly, $5\times10^5$ E0771-Ovalbumin expressing breast adenocarcinoma was subcutaneously implanted into wild type C57BL/6J and EpoR$^{\Delta CD11c}$ mice to observe changes in tumor size. Tumor size was measured at various time points (e.g., Day 6, 7, 9, 11). As shown in FIG. 6B, the size of the tumor from (ii) EpoR$^{\Delta CD11c}$ mice was smaller than the tumor from (i) wild-type mice. These results suggest that EPOR deletion from myeloid cells reduces lewis lung carcinoma and breast adenocarcinoma tumor burden in mice.

Colon Cancer

Figure 7A:
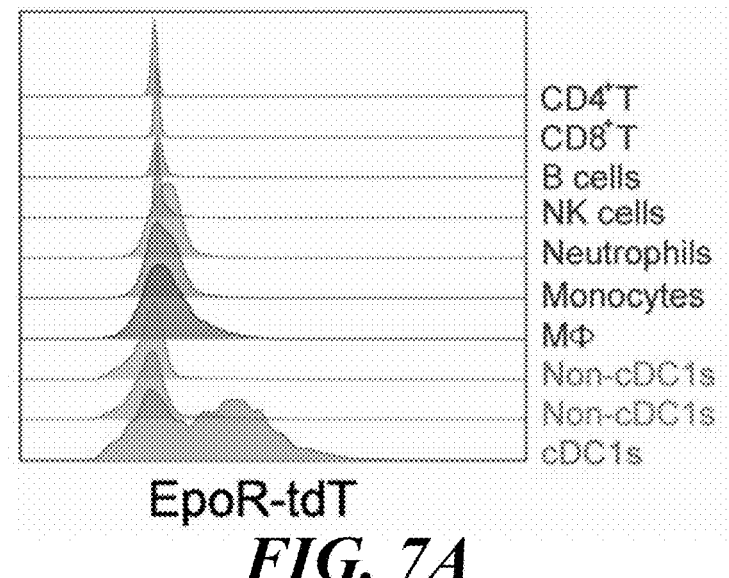
FIGS. 7A-7C illustrate tumor burden in mice with hetero-EPOR deleted dendritic cells.
Figure 7B:
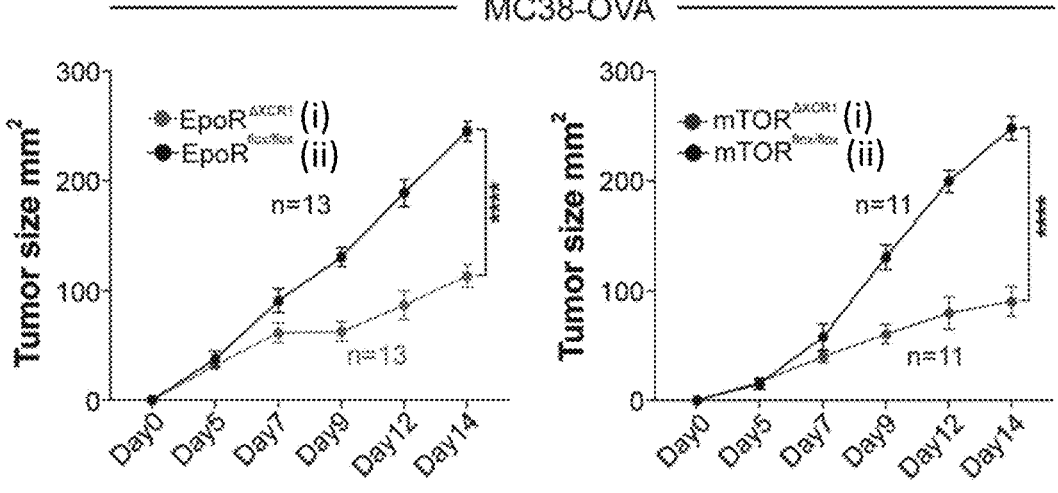
Figure 7C:
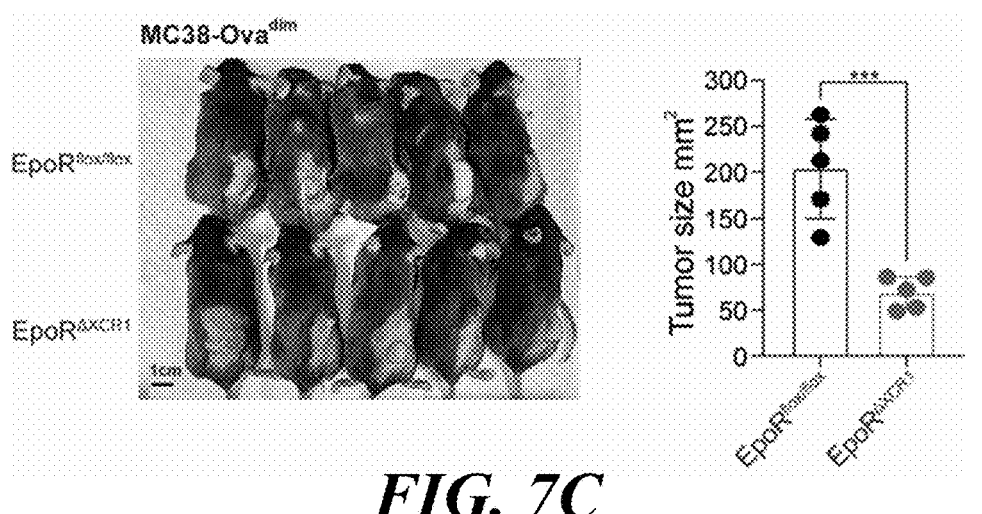

The effect of EPOR on colon cancer was investigated. Zbtb46$^{gfp/+}$EpoR$^{tdTomato/+}$ mice were implanted with MC38-Ova (colon cancer) cells ($5\times10^5$). These mice were used as Zbtb46 can be used to define conventional dendritic cells. On day 12, tumors were explanted followed by flow cytometric analysis of EpoR-tdTomato expression on tumor infiltrating immune cells (n=3-4). For flow cytometric analysis, classical dendritic cells (cDCs) were gated as live-dead blue$^-$CD45$^+$CD11c$^+$Zbtb46$^+$. cDC1s were gated as live-dead blue-CD45$^+$CD11c$^+$ Zbtb46$^+$ XCR1$^+$CD103$^+$ SIRPa$^-$. Non cDC1s were gated as live-dead blue$^-$CD45$^+$CD11c+ Zbtb46$^+$XCR1$^-$. Macrophages were gated as live-dead blue$^-$CD45$^+$CD3$^-$CD19-NK1.1$^-$MHCII$^{low}$Ly6C$^{low}$CD64$^+$F480$^+$ CX3CR1$^+$. Monocytes were gated as live-dead blue$^-$CD45$^+$ CD3$^-$CD19-NK1.1-Ly6C$^{high}$CD64$^{low}$Ly6G$^-$. Neutrophils were gated as live-dead blue$^-$CD45$^+$CD3-CD19-NK1.1- CD11b$^+$Ly6G$^-$. T cells were gated as live-dead blue$^-$CD45$^+$ CD3$^+$CD19$^-$NK1.1$^-$CD11b$^-$. B cells were gated as live-dead blue CD45$^+$CD3$^-$CD19$^+$NK1.1$^-$CD11b$^-$. NK cells were gated as live-dead blue$^-$CD45$^+$CD3$^-$CD19-NK1.1$^-$ CD11b$^-$. As shown in FIG. 7A, flow cytometric analysis showed that EPOR is expressed in various infiltrating immune cells, with the most expression in cDCs of Zbtb46$^{gfp/+}$EpoR$^{tdTomato/+}$ mice implanted with MC38-Ova. Thus, EPOR was knocked out in cDCs of mice (EpoR$^{\Delta XCR1}$) to determine whether deletion of EPOR in cDCs would affect colon cancer tumor growth. $5\times10^5$ MC38-Ova$^{dim}$ cells were subcutaneously implanted into EpoR$^{flox/flox}$ and EpoR$^{\Delta XCR1}$ mice. mTOR$^{flox/flox}$ and mTOR$^{\Delta XCR1}$ mice were also subcutaneously implanted with $5\times10^5$ MC38-Ova$^{dim}$ cells as controls. As shown in FIGS. 7B (right graph)-7C, (i) EpoR$^{\Delta XCR1}$ mice had a statistically significant decrease in tumor size than (ii) EpoR$^{flox/flox}$ mice. Similar effect was observed in (ii) mTOR$^{flox/flox}$ and (i) mTOR$^{\Delta XCR1}$ mice, where mTOR$^{\Delta XCR1}$ mice had a statistically significant decrease in tumor size than mTOR$^{flox/flox}$ mice (left graph of FIG. 7B). These results confirmed that EPOR deletion from cDCs reduces colon cancer tumor burden.

Hepatocellular Carcinoma (HCC)

Figure 8A:
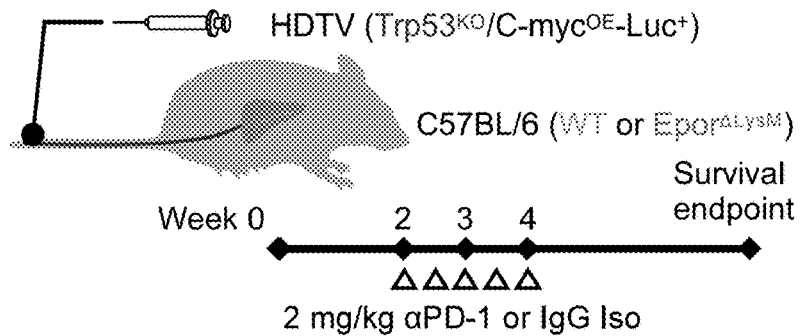
FIGS. 8A-8C illustrate an alteration in resistance to immune checkpoint blockade in cold tumors of mice that have macrophages with EPOR deletion (Epor$^{\Delta LysM}$).
Figure 8B:
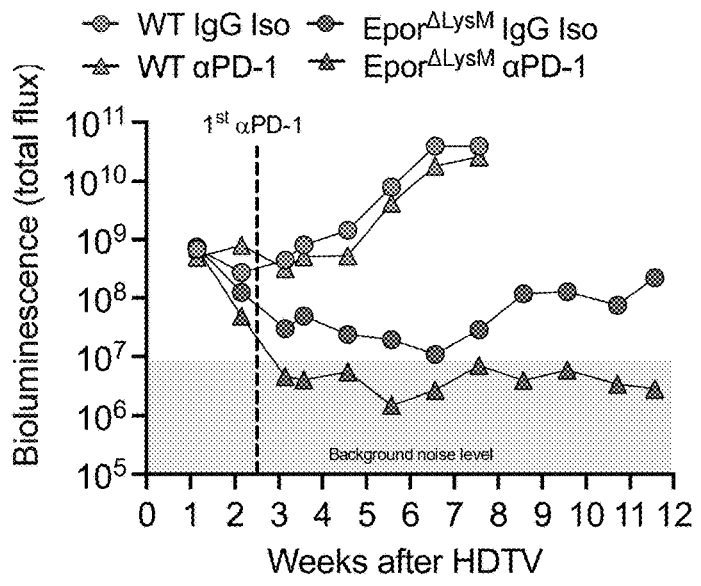
Figure 8C:
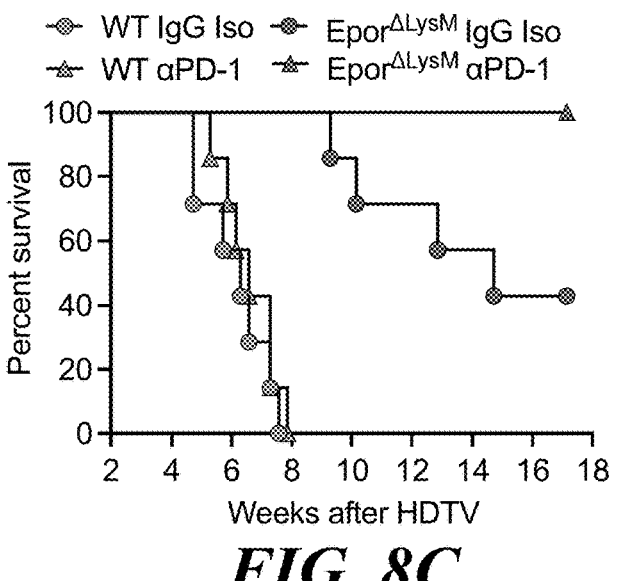

To see whether EPOR deletion affects resistance of tumors to immune checkpoint blockade (cold tumors), a spontaneous model of cold HCC was generated by delivering plasmids pCMV-SB13, pT3-EF1a-C-Myc-IRES-Luciferase, and pX330-sgRNA targeting Trp53 to the liver of C57BL/6J (WT) or EpoR$^{\Delta LysM}$ mice using hydrodynamic tail vein injection (HDTV) in vivo (Trp53$^{KO}$/C-myc$^{OE}$-Luc+) as shown in FIG. 8A. After two weeks, WT and EpoR$^{\Delta LysM}$ mice were treated with either 2 mg/kg of $\alpha$PD1 (e.g., Clone 29F.1A12, BioXCell) or IgG isotype via intraperitoneal injection (i.p.) as indicated in the experimental scheme shown in FIG. 8A. Next, bioluminescence assay was performed to monitor tumor burden by measuring the luciferin-based bioluminescence. As shown in FIG. 8B, EpoR$^{\Delta LysM}$ mice with IgG Isotype had lower bioluminescence than wild-type mice with IgG Isotype, signifying that knockout of EpoR in macrophages lowers tumor burden. With additional treatment with $\alpha$PD1 in EpoR$^{\Delta LysM}$ mice, tumor burden was further reduced. In addition to monitoring tumor burden, percent survival was also calculated. As shown in FIG. 8C, EpoR$^{\Delta LysM}$ mice with IgG Isotype and EpoR$^{\Delta LysM}$ mice with aPD1 had greater percent survival than wild-type mice with or without $\alpha$PD1.

Melanoma

To see how EPOR affects melanoma tumor burden, $1\times10^6$ of B16F10-Ova cells were subcutaneously implanted into EpoR$^{flox/flox}$ and EpoR$^{\Delta XCR1}$ mice to induce melanoma. 2 mg/kg of $\alpha$PD1 (e.g., Clone 29F.1A12, BioXCell) was given i.p. as indicated in the experimental scheme shown in FIG. 9A. Melanoma tumor size was measured across various timepoints (e.g., day 0, 7, 8, 11, 13, 15). As shown in FIG. 9B, (iii) EpoR$^{\Delta XCR1}$ mice had a statistically significant decrease in tumor growth than (i) control mice. Furthermore, (iv) EpoR$^{\Delta XCR1}$ mice treated with $\alpha$PD1 had a statistically significant decrease in tumor growth than (ii) control mice with $\alpha$PD1 and EpoR$^{\Delta XCR1}$ mice without $\alpha$PD1, suggesting that the knockout of EpoR in cDCs combined with $\alpha$PD1 can further reduce tumor growth compared to without combining with $\alpha$PD1. On day 12 after tumor implantation, tumor infiltrating CD8+ T cells were analyzed for effector T cell markers. T cells were gated as live-dead blue$^-$CD45$^+$ CD3$^+$CD8$^+$CD11b$^-$MCII$^-$, and expression of Perforin$^+$, Granzyme B$^+$, interferon gamma (IFN$\gamma^+$) and tumor necrosis factor alpha (TNF$\alpha$+) were analyzed by flow cytometry as shown in FIG. 9C. Flow cytometry data revealed that EpoR$^{\Delta XCR1}$ mice have elevated inflammatory cytokines (Perforin: 56%, IFN$\gamma$: 33.4%, GranzymeB+: 45.6%, TNF$\alpha$: 43.4%) and effector CD+ T cells than EpoR$^{flox/flox}$ mice (Perforin: 14%, IFN$\gamma$: 11.1%, GranzymeB+: 7.26%, TNF$\alpha$: 2.78%), suggesting that when EPOR is absent in cDC1s, immune checkpoint blockade (ICB)-resistant cold tumor (e.g., melanoma) can be converted into ICB-sensitive tumors.

Colon Cancer in Presence of Liver Metastasis

Figure 12A:
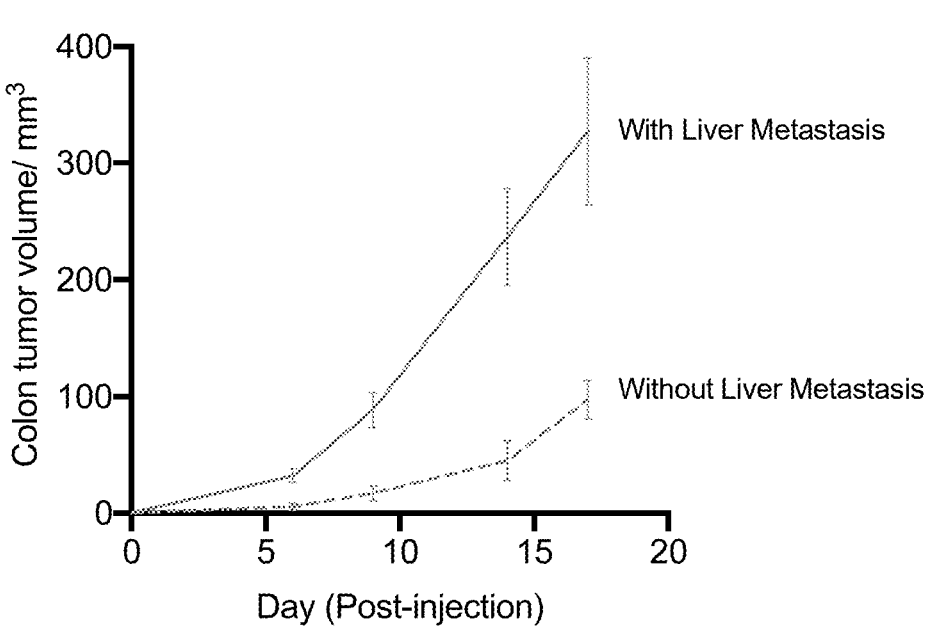
FIGS. 12A-12B illustrate colon tumor growth in mice with or without liver metastasis.
Figure 12B:
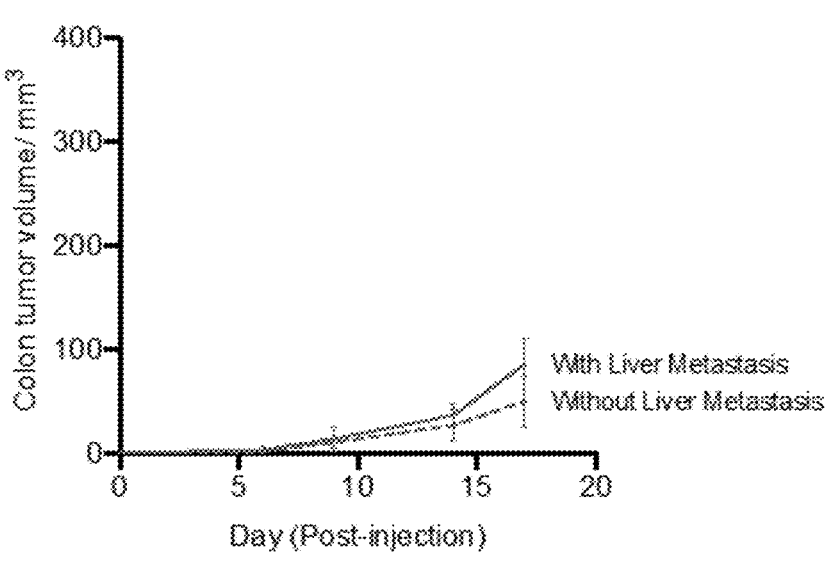

Liver metastasis can promote tumor growth and can diminish immunotherapy efficacy. Thus, whether deletion of hetero-EPOR can abrogate the acceleration of tumor growth by liver metastasis was investigated. First, wild-type mice were implanted with MC38 tumor cells (e.g., $5\times10^5$) subcutaneously, or subcutaneously and at the liver to model liver metastasis. Next, colon tumor growth was monitored. As shown in FIG. 12A, with liver metastasis there was greater colon tumor growth than without liver metastasis, confirming that liver metastasis promote tumor growth. To see how knockout of hetero-EPOR in macrophage can affect tumor growth with or without liver metastasis, EpoR$^{\Delta LysM}$ mice were implanted with MC38 tumor cells (e.g., $5\times10^5$) subcutaneously, or subcutaneously and at the liver to model liver metastasis. As shown in FIG. 12B, EpoR$^{\Delta LysM}$ mice with or without liver metastasis had decreased tumor growth as compared to with wildtype mice with liver metastasis.

These results suggest that liver metastasis can accelerate the growth of primary colon tumor; however, this effect can be prevented in the absence of EPOR in macrophages.

Example 20. Effect of EPO Overexpression on Tumor Burden

Figure 10:
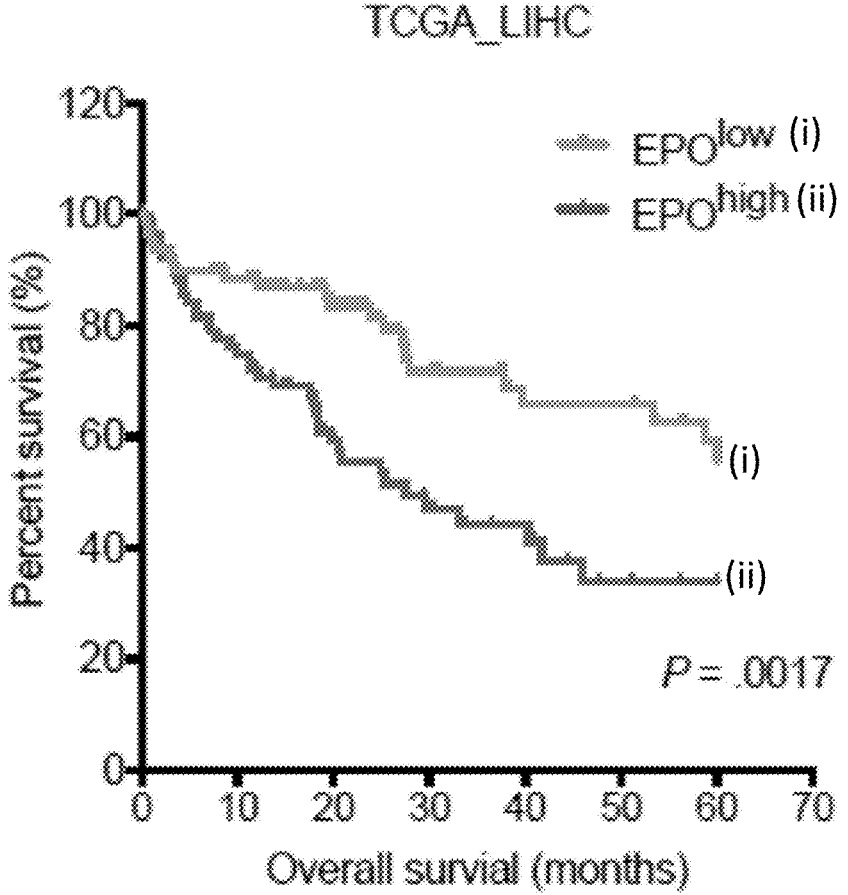
FIG. 10 shows percent survival data from The Cancer Genome Atlas Liver Hepatocellular Carcinoma (TCGA-LIHC) of patients with hepatocellular carcinoma with (i) low versus (ii) high levels of EPO.
Figure 11A:
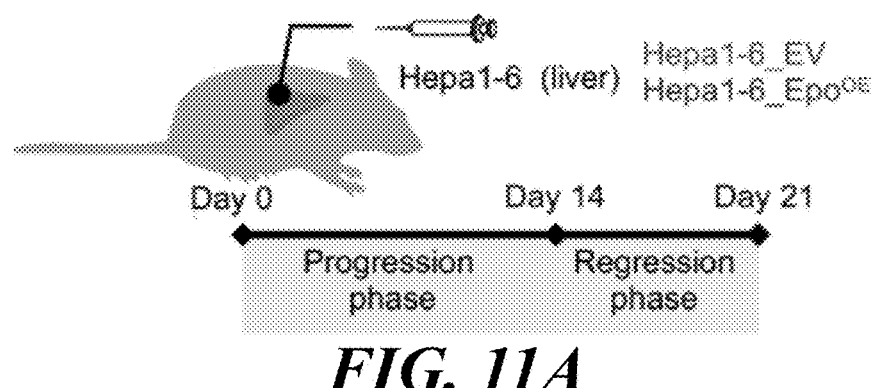
FIGS. 11A-11C illustrate effect of EPO on advancement of tumors in mice with regressive hepatocellular carcinoma (HCC).
Figure 11B:
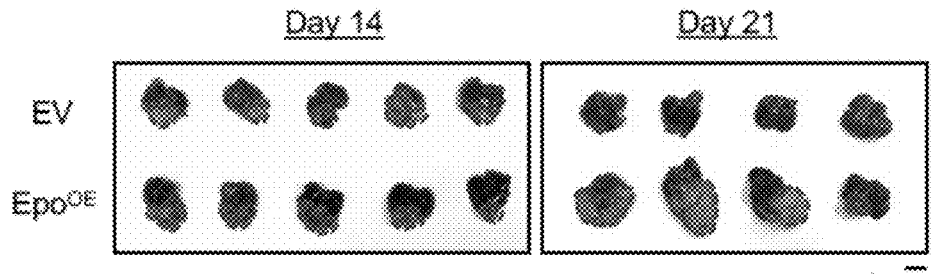
Figure 11C:
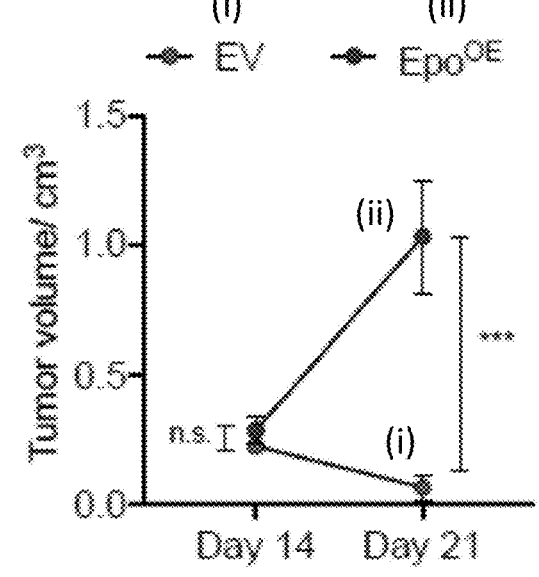

Data from Cancer Genome Atlas Liver Hepatocellular Carcinoma (TCGA-LIHC) shows that patients with high EPO levels had lower percentage of survival compared to patients with low EPO levels (FIG. 10). Thus, the effect of EPO on advancement of tumors in mice with regressing HCC was explored. Regressive HCC model was established by orthotopically implanting allogeneic $3\times10^6$ Hepa1-6 cells to C57BL/6 mice, as shown in the experimental scheme in FIG. 11A. While tumors grew continuously in the first two weeks following injection, spontaneous tumor regression (complete or partial) was observed on Day 21. In addition, two Hepa1-6 stable cell lines were generated by using lentiviruses, with either empty vehicle (Hepa1-6_EV) or with overexpression of EPO (Hepa1-6_Epo$^{OE}$), as shown in the experimental scheme in FIG. 11A. At day 14 after the progression phase, and at day 21 after the regression phase, tumors were harvested (FIG. 11B) and the size of tumors was measured. Quantification of tumor volume and complete response (CR) rate showed that mice with EPO overexpression had greater tumor volume than mice without EPO overexpression at day 21 (FIG. 11C), suggesting that overexpression of EPO enables tumor growth in regressive HCC.

Example 21. Effect of EPO and EPOR Modulation on Tumor Burden

Figure 13A:
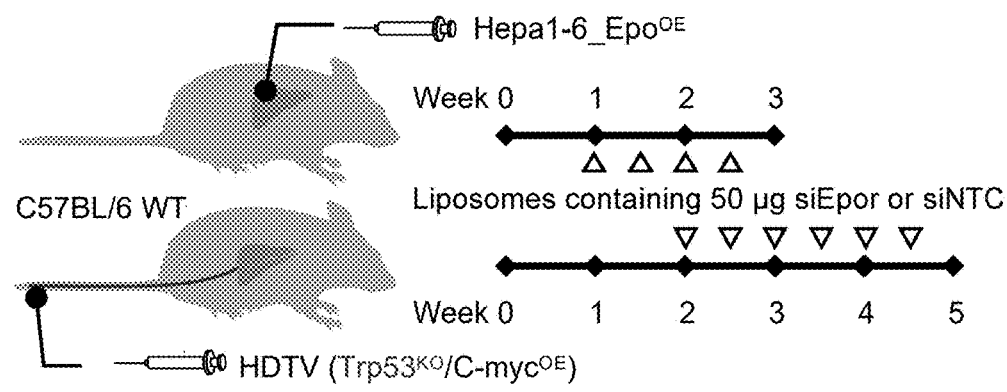
FIGS. 13A-13C illustrate effect of macrophage-targeted liposomes loaded with siRNA targeting EPOR (siEpor) in mice with hepatocellular carcinoma (Hepa1-6_Epo$^{OE}$).
Figure 13B:
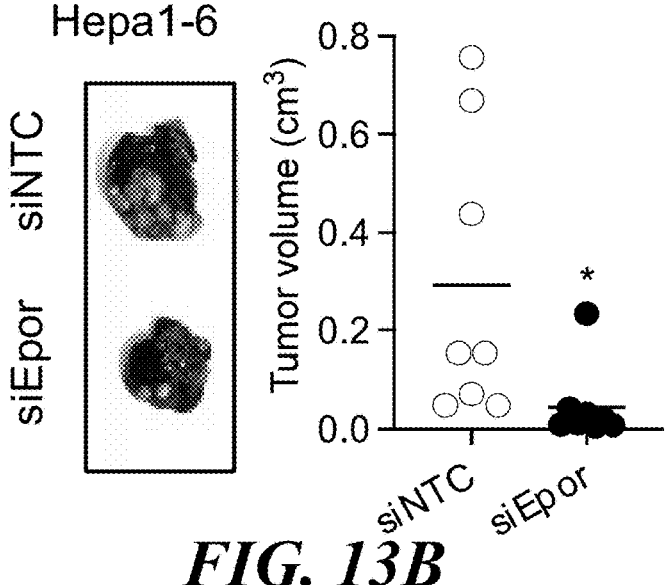
Figure 13C:
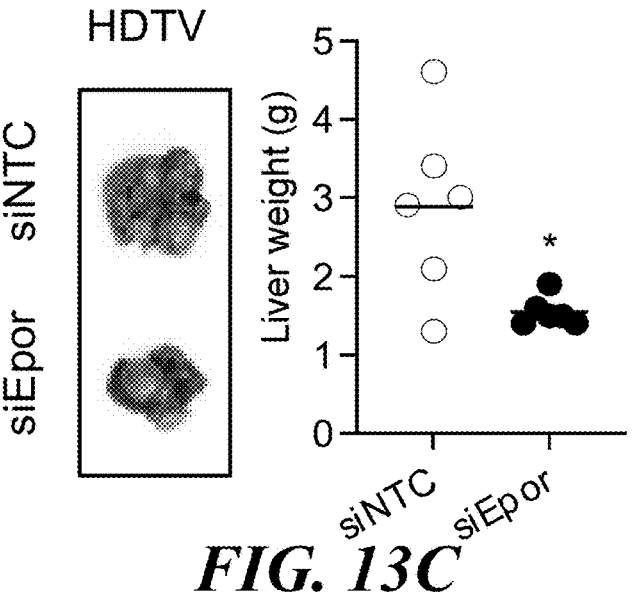

As demonstrated in Example 19, deletion of hetero-EPOR in myeloid cells lead to a decrease in tumor growth. When there is overexpression of EPO, as demonstrated in Example 20, there is an increase in tumor growth. Thus, how tumor burden is affected by knockdown of hetero-EPOR in mice with hepatocellular carcinoma (HCC) with EPO overexpression was explored. As shown in the experimental scheme in FIG. 13A, C57BL/6 mice were orthotopically implanted with $3\times10^6$ of Hepa1-6 cells that overexpress EPO (Hepa1-6_Epo$^{OE}$). After one week, mice were treated with liposomes containing 50 μg of either siRNA targeting EPOR (siEpor) or non-target control siRNA (siNTC) via intravenous injection every four days for a total of three doses. After three weeks post-injection, tumors were harvested, as shown in FIG. 13B, and the tumor volume was measured. In addition, a spontaneous model of cold HCC was generated by delivering plasmids pCMV-SB13, pT3-EF1a-C-Myc, and pX330-sgRNA targeting Trp53 to the liver of mice using hydrodynamic tail vein injection (HDTV) in vivo (FIG. 13A). After two weeks, mice were treated with liposomes containing 50 μg of either siEpor or siNTC via intravenous injection every four days for a total of six doses (FIG. 13A). After five weeks post-injection, livers were harvested, as shown in FIG. 13C, and liver weight was measured. The results showed that tumors from mice treated with siEpor had decreased tumor volume compared to mice treated with siNTC, suggesting that knocking down EPOR by using siEpor can reduce tumor growth in mice even when EPO is overexpressed.

In addition, macrophage-targeted liposomes loaded with siRNA targeting EPOR were tested. Physical properties of the macrophage-targeted liposomes are shown in FIG. 14A. To confirm the liposomes are targeted specifically to macrophages, C57BL/6 mice implanted with Hepa1-6_Epo$^{OE}$ were administrated with liposomes loaded with 50 μg of fluorescein isothiocyanate (FITC)-conjugated siRNA. After 24 hours, tumors were harvested and dissociated into single cell suspension. Using flow cytometry analysis the percentage of FITC$^+$ cells in different myeloid cell types were measured. As shown in FIG. 14B flow cytometry analysis indicated that macrophages are the major cell type that take up the liposomes. Next, to test the knockdown efficiency of siRNA targeting EPOR, $3\times10^6$ Epo-overexpressing Hepa1-6 cells were orthotopically implanted in C57BL/6 mice. After one week, mice were treated with liposomes containing 50 μg of either siRNA targeting EPOR (siEpor) or non-target control siRNA (siNTC) via intravenous injection every four days for a total of three doses. Tumors were harvested after 3 weeks post-injection and dissociated into single cell suspension. Macrophages were isolated with magnetic-activated cell sorting and RNA was extracted for real-time PCR quantification. The knockdown efficiency of EPOR in tumor-infiltrating macrophages is shown in FIG. 14C. EPOR mRNA levels in macrophages from mice injected with siEpor were lower than EPOR mRNA levels in macrophages from mice injected with siNTC (FIG. 14C).

Example 22. EPOR Expression in Patients with Cancer

Human fresh tumor or tumor metastasis specimens were dissected from patients by surgery. Fresh specimens were digested with a blend of enzymes for tissue dissociation and cell isolation (Liberase™ TL) and DNase, and single cell suspension was made by lysing red cells with Ammonium-Chloride-Potassium (ACK) lysis buffer. CD45+ tumor infiltrating immune cells were further analyzed with anti-CD11c, anti-HLA-DR, anti-CD123, anti-CD14, anti-CD16, anti-CD141, anti-anti-XCR1, anti-CD1c, anti-CD131 and anti-EpoR ab by flow cytometry. Liver metastasis paired blood were analyzed by flow cytometry in the same way. Healthy donor blood, and liver cancer or liver cirrhosis patient blood were used to compare with EpoR+ cell percentage in liver metastasis patient blood CD45+ cell.

Figure 15A:
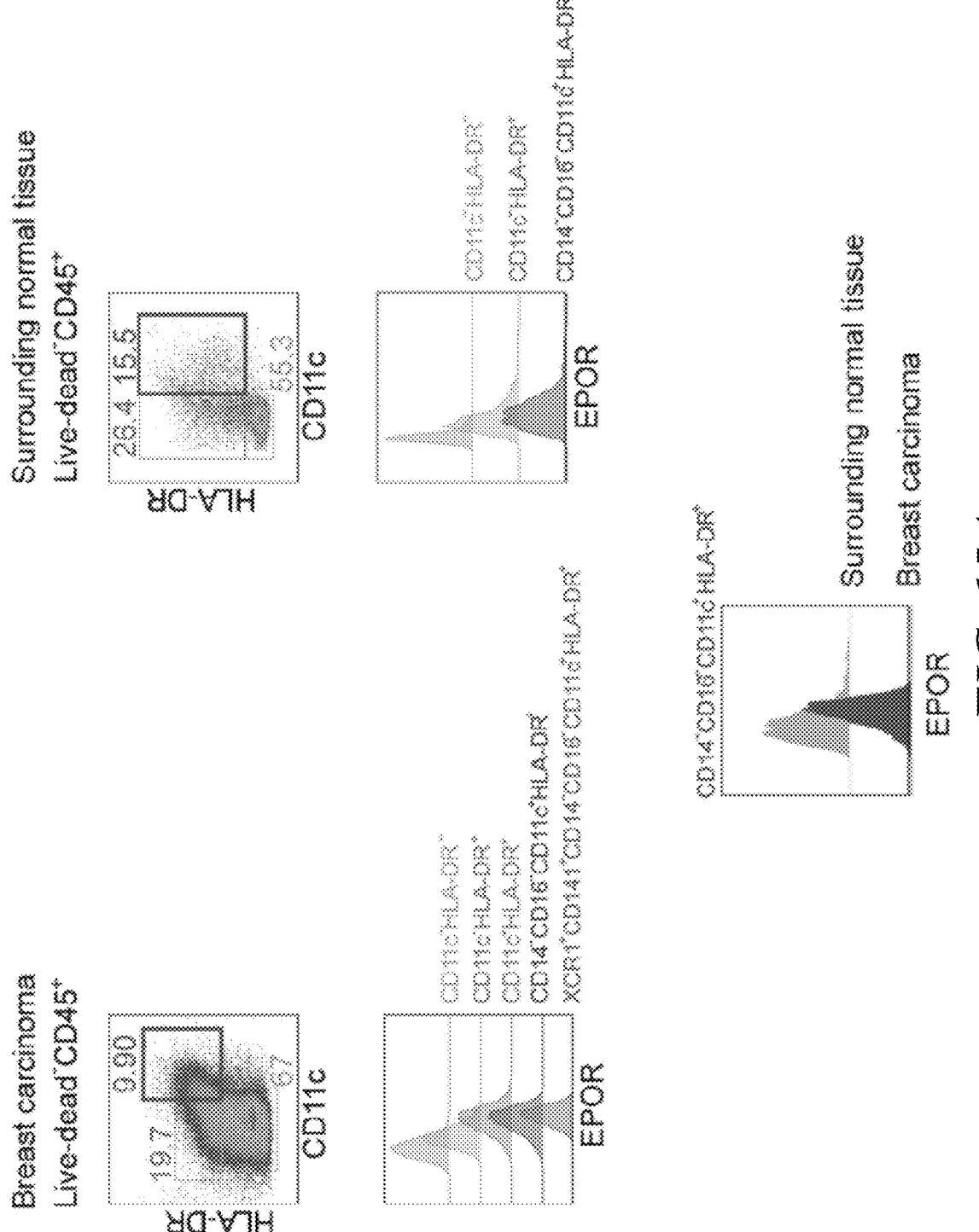
FIGS. 15A-15B illustrate EPOR expression on myeloid cells from human fresh cancer specimens of breast cancer (FIG. 15A) and breast cancer left axillary lymph node metastasis metastatic site (FIG. 15B).
Figure 15B:
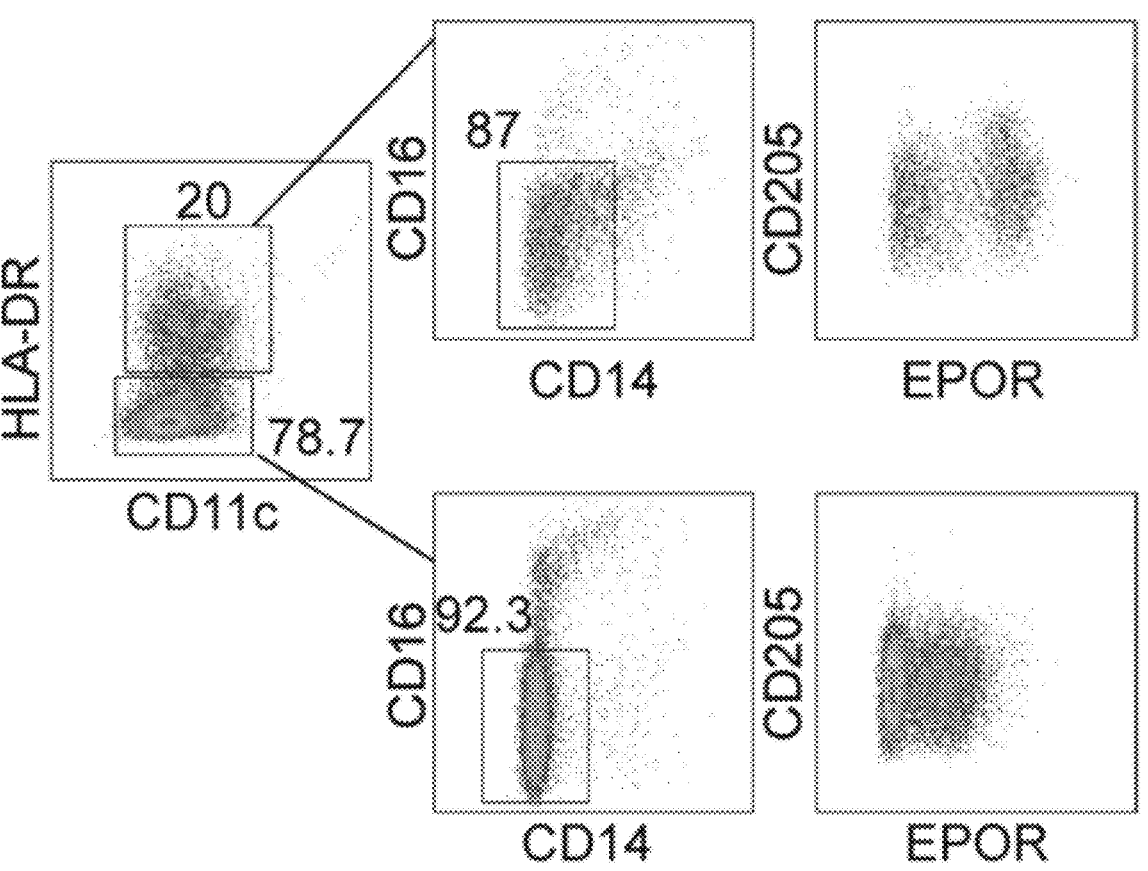

Myeloid cells from patients with breast cancer were collected and analyzed for EPOR expression with flow cytometry, as shown in FIG. 15A. Flow cytometry showed that myeloid cells from patients with breast cancer expressed high levels of EPOR. As shown in FIG. 15B, myeloid cells from breast cancer metastatic lymph node also expressed high levels of EPOR.

Figure 16A:
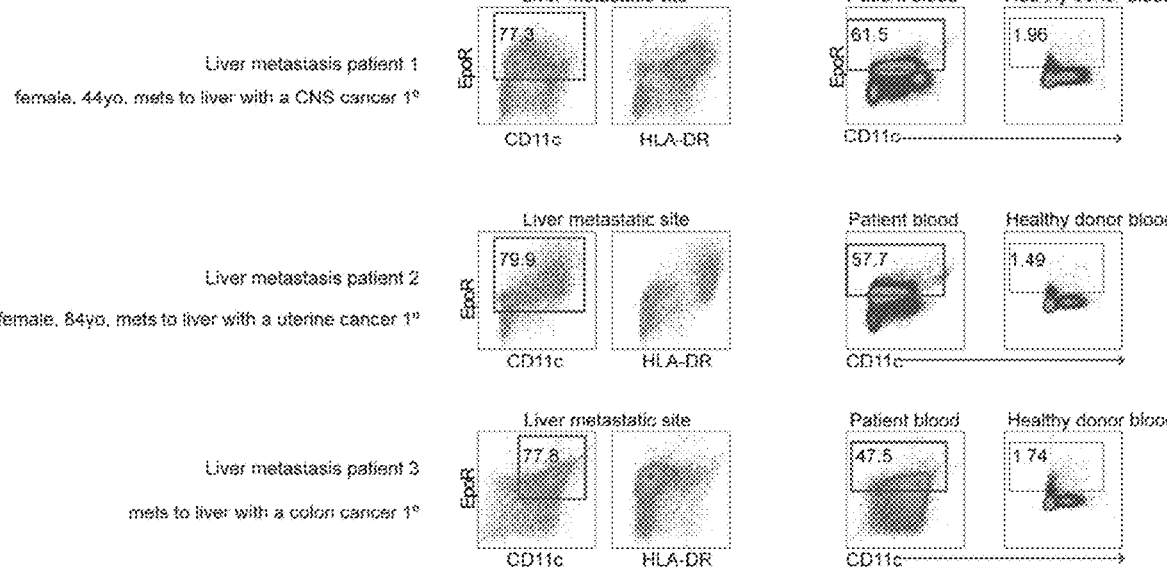
FIGS. 16A-16B illustrate EPOR expression on myeloid cells in human fresh liver metastasis metastatic sites paired with peripheral blood samples. Samples were collected from three individual patients with different original tumor type.
Figure 16B:
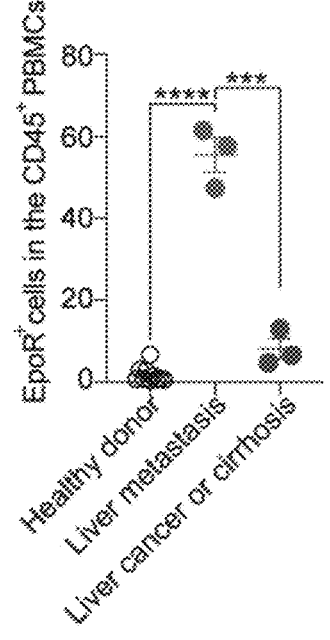

The amount of Epor+ peripheral blood mononuclear cells (PBMCs) of patients with metastatic liver cancer, patients with liver cancer or cirrhosis, and healthy donor were analyzed via flow cytometry and quantified as shown in FIG. 16A and FIG. 16B, respectively. PBMCs of patients with metastatic liver cancer had higher frequencies of Epor+ cells than PMBCs of healthy donor or patients with liver cancer.

Example 23. Antibodies Against the Homo-EPOR

Antibodies against the homo-EPOR are generated with animal immunization. The extracellular domains of EPOR are used to immunize the animals. The antigen specific B cells or hybridoma cells are isolated and the immunoglobulin genes are sequenced. The recombinant antibodies will be subjected to the antigen binding assays with the extracellular domains of homo-EPOR or the soluble homo-EPOR, and the staining assays on the cells expressing EPOR. The cells staining with antibodies specific to the homo-EPOR are further characterized for receptor activation by analyzing phosphorylation of the receptor, JAK2, and STAT5 after the receptor expressing cells are treated with the antibody with or without EPO.

Alternatively, the homo-EPOR specific antibody can be isolated by screening an antibody expression library, e.g., phage display, yeast display, ribosomal display, cell display.

Anti-homo-EPOR antibodies can be agonists or antagonists for homo-EPOR. Some anti-homo-EPOR antibodies can be agonists or antagonists for the hetero-EPOR.

The binding affinity of the homo-EPOR antibodies to the extracellular domains of a homo-EPOR is determined using a functional ELISA. Soluble homo-EPOR (Sino Biological) are coated on a standard ELISA. The wells are blocked with 2% BSA. Dilutions of anti-homo-EPOR antibodies are added to the plates and incubated. After washing, the bound anti-homo-EPOR antibodies are detected using biotinylated polyclonal anti-EPO (R&D Systems) followed by streptavidin HRP conjugate or other appropriate secondary antibodies. After washing, TMB reagent (Sigma) is added and OD absorption at 450 nm is measured in a plate reader.

Example 24. Erythropoiesis Stimulating Activity and/or Antigen Specific Tolerance Activity of Agonistic Anti-Homo-EPOR Antibodies Agonistic antibodies specific to the homo-EPOR are tested similarly as described in Example 6.

Example 25. Erythropoietic Activity of Anti-Homo-EPOR Antibodies

Agonistic antibodies specific to the homo-EPOR are tested similarly as described in Example 8.

Example 26. Antibodies Against the Hetero-EPOR

Antibodies against the hetero-EPOR were generated with animal immunization. Chimeric Fc fusion proteins of the extracellular domains of human EPOR and human CD131 (Sino Biological, Cat #CTO10-H02H) were immunized in the ATX-GK and ATX-GL mice from Alloy Therapeutics. The ATX-GK strain contains the human antibody heavy chains and the human antibody kappa light chains whereas the ATX-GL strain contains the human antibody heavy chains and the human antibody lamda light chains. B cells from spleen and lymph nodes were harvested after immunization.

The B cells from ATX-GL mice were stained with fluorescence labeled recombinant hEPOR-Fc Fc (Sino Biological, Cat #10707-H02H) and hCD131-Fc (IME021, in house). After counter screening with an irrelevant human Fc fusion protein, the positive B cells that bind hEPOR-Fc, hCD131-Fc, or both were sorted into 3 populations and subjected to single cells sequencing. 188, 136, and 129 unique human antibody sequences were obtained from the EPOR-Fc binders, the CD131-Fc binders, and the EPOR-Fc/CD131-Fc binders, respectively. The VH-CDR3, VL-CDR3, full length VH, and full length VL sequences are listed in Tables 4-9.

Figure 17:
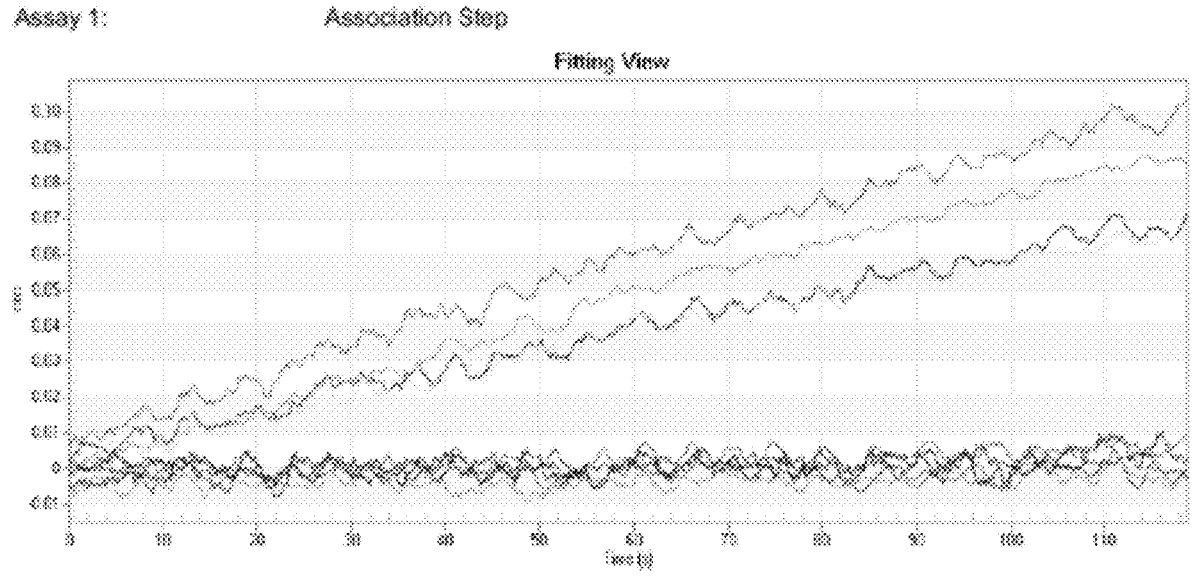
FIG. 17 shows an example of EPO blocking efficiency of hybridoma clones listed in Table 11.

The B cells from ATX-GK mice were fused with mouse myeloma cells to generate hybridoma. The hybridoma cells were screened twice. In the first screening, 293 cells expressing human EPOR, human CD131, or both were used as the primary screen. 87 hybridoma antibodies have been isolated by positive staining on 293T cells expressing human EPOR (hEPOR), human CD131 (hCD131), or both, with the hybridoma supernatants (Table 11 and FIG. 17). Hybridoma clones and their efficiency of blocking EPO/EPOR interaction are shown in Table 11 and FIG. 17. Expression of EPOR and CD131 was confirmed by flow cytometry with Phycoerythrin (PE)-labeled anti-EPOR (R&D Systems, Cat #FAB307P) and Alexa Fluor® 647 (AF647)-labeled anti-CD131 (BD Biosciences, Cat #564191), respectively (FIG. 28B). All hybridoma clones were purified and sequenced. 17 clones with unique antibody sequences are shown in Table 10 and FIG. 28A. Binding kinetics with soluble hetero-EPOR (EPOR-CD131-Fc), soluble EPO receptor subunit of hetero-EPOR (EPOR-Fc), and soluble CD131 subunit of hetero-EPOR (CD131-Fc) were measured in using bio-layer interferometry (Octet®) BLI by capturing the hybridoma antibodies in the supernatants on biosensors coated with anti-mouse Fc first and dipping the biosensors into the solutions containing 30 nM of the soluble receptor Fc fusion proteins. The supernatants were also used to block the interaction between EPO and EPOR. The soluble EPOR-CD131-Fc was first captured on biosensors coated with anti-human Fc and then dipped into 10 nM of EPO with or without the hybridoma supernatants. Clones M1 and M2 exhibited potent binding to EPOR-CD131-Fc and EPOR-Fc. Clone M82 exhibited potent binding to CD131-Fc. Clone M26 bound all three soluble receptors with high affinity (FIG. 28A). Clone M2 exhibited nearly complete blocking on the EPO/EPOR interaction while clones M1, M3, M9, M19, M24, M26, M41, M52, M54, M82, and M87 exhibited partial blocking activities. Clones M37, M38, M43, M71, and M80 did not block the EPO/EPOR interaction under this condition (FIG. 28A).

The purified antibodies were used to stain the human leukemia UT-7 cells, 293T/EPOR, 293T/CD131, and 293T/EPOR/CD131 cells to confirm antigen binding. The UT-7 cells were maintained in Roswell Park Memorial Institute (RPMI) with 10% Fetal Bovine Serum (FBS) and 5 ng/ml of recombinant human GM-CSF (Peprotech®, Cat #300-03). The 293T cells expressing hEPOR, hCD131, or both were maintained in Dulbecco's Modified Eagle Medium (DMEM) with 10% FBS. $1 \times 10^6$ cells/ml were incubated with purified hybridoma clones M2 and M41 at a 3-fold dilution series starting from 20 μg/ml for 30 minutes at 4° C. After washing, the cells were incubated with PE labeled secondary antibody and subjected to flowcytometric analysis. Both M2 and M41 exhibited robust binding activities at 20 μg/ml. However, M2 showed ~100% mean or median fluorescence intensity (MFI) at 27 ng/ml whereas M41 lost most of the binding at 0.74 pg/ml, suggesting M2 has a higher affinity for anti-EPOR binding than M41 (FIG. 29A). The binding profiles of the 293T/EPOR/CD131 cells are similar except the peak MFIs around 1500, half of that of the 293T/EPOR cells (FIG. 29B). M2 and M41 did not stain the 293T/CD131 cells indicating they are specific to EPOR (FIG. 29C). M2 exhibited a much more stronger staining signal on the UT-7 cells with MFI ~18,000 suggesting a higher expression level of EPOR in the UT-7 cells (FIG. 29D). However, the peak staining signal of M41 on the UT-7 cells was similar to that of 293T/EPOR cells suggesting the epitopes these two clones bind on EPOR may be different (FIG. 29D).

EPOR activation leads to phosphorylation of Stat5. A flow-based assay on phosphorylated Stat5 was set up to test the blocking activities of anti-EPOR antibodies. The UT-7 cells were cultured without GM-CSF for overnight before the EPO stimulation. $3 \times 10^6$ cells/ml were incubated with 20 μg/ml of anti-EPOR for 15 minutes before stimulation with 0.1 pg/ml of recombinant human EPO (Peprotech®, Cat

100-64) for 10 minutes at 37° C. The cells were fixed immediately with fixation buffer (Cytofix™ buffer; BD Biosciences, Cat #554655) and permeabilized with methanol. After washing, cells were stained with PE labeled anti-Stat5 (BD Biosciences, Cat #612567) and subjected to flow cytometry analysis. M2 exhibited complete blocking on the Stat 5 phosphorylation whereas M41 showed partial blocking (FIG. 30).

In the second screening, ELISA binding assays of the recombinant hEPOR-Fc, mEPOR-Fc (IME066, in house), and a heterodimeric knobs-in-holes Fc fusion protein of hEPOR ECD and hCD131 D3-D4 domains (IME027/078, in house) were used as the primary screen. 205 positive clones were isolated and expanded.

Example 27. Erythropoiesis Stimulating Activity and/or Antigen Specific Tolerance Activity of Agonistic Anti-Hetero-EPOR Antibodies Agonistic antibodies specific to the hetero-EPOR are tested similarly as described in Example 6.

Example 28. Erythropoietic Activity of Anti-Hetero-EPOR Antibodies

Agonistic antibodies specific to the hetero-EPOR are tested similarly as described in Example 8.

Example 29. Treatment of Chronic Infection by EPOR Antagonists (Anti-EPO Antibodies, Anti-EPOR Antibodies, Anti-CD131 Antibodies, and/or EPO Analogs/Engineered EPOs)

Hetero-EPOR antagonists (anti-EPO antibodies, anti-EPOR antibodies, anti-CD131 antibodies, and/or EPO analogs/engineered EPOs that have antagonistic effects to hetero-EPOR) are administered to a chronic Lymphocytic choriomeningitis virus (LCMV) model. Mice are infected with $2 \times 10^6$ plaque-forming units (PFU) of LCMV-c13 by intravenous injection. The mice are treated with the EPOR antagonist by i.p. injection once or twice a week. At day 21, LCMV specific endogenous CD8+ T cells are detected by gp33-tetramer in CD8+ TCRb+ T cells. Further detailed analysis of the gp33+ T cell fate are determined with anti-CD44, anti-PD-1, anti-Tim3, anti-SLAMF6, anti-CX3CR1, anti-KLRG1, and anti-TCF1 abs by flow cytometry in the spleen, lung and liver.

Example 30. Selectivity and Specificity of Anti-EPO, Anti-EPOR, and Anti-CD131 Antibodies Anti-EPO, anti-EPOR, and anti-CD131 antibodies described herein are tested and analyzed for specificity and selectivity. Antibody specificity can be assessed by comparing binding signals in cells that express an endogenous level of a target, to binding signals in cells that overexpress a target, or to binding signals in cells that do not express a target. Antibodies with high specificity will have binding signal that responds proportionately with the amount of target protein present in cells and will not show any significant levels of non-specific binding signals (at the optimal dilution of the antibodies) in cells that do not express a target. 293T cells are transduced with lentiviruses encoding human EPOR or human CD131 to generate 293T cells expressing EPOR, CD131, or both. Anti-EPOR or anti-CD131 antibodies are used to stain the wild-type 293T cells, 293T/EPOR cells, 293T/CD131 cells, or 293T/EPOR/

CD131 cells to confirm the binding specificity (FIG. 28B). The antibody specificity can also be assessed by binding to the soluble receptors. The extracellular domains of EPOR or CD131 are produced as soluble Fc fusion proteins. The heterodimeric EPOR/CD131 is also produced as soluble Fc fusion proteins by knobs-in-holes design. These soluble receptor Fc fusion proteins are used to bind the antibodies in ELISA assays or bio-layer interferometry Octet® BLI assays (FIGS. 24A and 32D).

Antibody selectivity can be assessed by comparing the reactivity to the intended target protein to the reactivity to other closely related proteins. Antibodies with high selectivity will have strong binding signal to a target protein without cross-reactivity to other closely related proteins (at the same time and at the same dilution), which can be tested by using antibodies to other related proteins (positive control antibodies). EPOR is a classical type-I cytokine receptor that belongs to the cytokine receptor family that also includes growth hormone receptor, prolactin receptor, and thrombopoietin receptor. CD131 is a common β chain receptor for GM-CSF, TL3, and TL5 as well. The anti-EPOR and anti-CD131 antibodies will be tested against these receptors for selectivity.

Example 31. Effect of EPOR Deletion on Tumor Ag-Specific CD8$^+$ T-Cell

In this example, how EPOR deletion in dendritic cells affects tumor Ag-specific CD8$^+$ T-cells was investigated. As shown in FIG. 27A, control mice, mice with EpoR knockout in dendritic cells (EpoR$^{\Delta XCR1}$), and mice with mTOR knockout in dendritic cells (mTOR$^{\Delta XCR1}$) were given s.c. injection of B16F10-Ova to induce melanoma tumor at day 0 (D0). At day 7 (D7), mice were given i.v. injection of OT-I (CD8$^+$ T-cells expressing T cell antigen receptor). At day 14, OT-I were isolated from tumor-draining lymph nodes (tdLN) of the mice, and the cells were analyzed by flow cytometry. The cells were analyzed for cell proliferation, as measured by a fluorescent dye for cell labeling (CellTrace™ Violet), and for expression of exhausted T-cell markers (e.g., CD44, SLAMF6, PD-1, and Tim3), as shown in FIG. 27B. Flow cytometry data showed that EpoR$^{\Delta XCR1}$ and mTOR$^{\Delta XCR1}$ mice had 80.2% and 82.2% cells expressing CD44, a marker of progenitor exhausted T-cells, compared to 55.2% cells from control mice. Number of cells expressing SLAMF6, another marker of progenitor exhausted T-cells, was also measured via flow cytometry, and showed that EpoR$^{\Delta XCR1}$ and mTOR$^{\Delta XCR1}$ mice had more SLAMF6-expressing cells than control mice. There were, however, no significant changes in number of cells expressing markers of terminally exhausted T-cells (e.g., PD-1 and Tim3), compared to control mice. These data suggested that dendritic cell specific knockout of EpoR or mTOR can regulate Ag-specific CD8+ T-cell priming toward progenitor exhausted T-cells, which can be easier to control in tumor progression than terminally exhausted T-cells. Furthermore, quantification of percent of proliferated OT-I showed that EpoR$^{\Delta XCR1}$ and mTOR$^{\Delta XCR1}$ mice had statistically significant increased percent of proliferated OT-I compared to control (FIG. 27C), suggesting that changes in proliferation of OT-I cells with changes in markers for exhausted T-cell compared to control can be a possible mechanism for reduced tumor burden in mice with EpoR$^{\Delta XCR1}$ as shown in Example 19.

Example 32. Effect of CEPO in Antigen-Specific Tolerance

CD11c$^{Int}$MHCII$^{High}$XCR1$^+$cDC1s collected from peripheral lymph nodes (pLN) of mice were loaded with irradiated Ova-thy cells, cocultured with naïve OT-II cells, and were either left untreated or treated with EPO or carbamylated (CEPO). CD11c$^{Int}$MHCII$^{High}$XCR1$^+$cDC1s with or without EPO/CEPO treatment were analyzed for FoxP3 expressing cells and proliferation with a fluorescent dye for cell labeling (CellTrace™ Violet), via flow cytometry. As shown in FIG. 38A, flow cytometry analysis revealed that treatment with EPO or CEPO led to increased FoxP3 expressing cells at 71.2% or 69.3%, respectively, compared to untreated cells at 25.5%. Furthermore, quantification of the percent FoxP3+ Tregs in live OT-II showed statistically a significant increase in the percentage of FoxP3+ Tregs with EPO or CEPO treatment compared to cells with no treatment. Since CEPO activates hetero-EPOR and not homo-EPOR, the result of increased FoxP3+ Tregs in live OT-II with CEPO treatment suggest that hetero-EPOR activation mediates antigen-specific tolerance.

For further in vitro studies on the effect of CEPO with potential dependency to EPOR or mTOR, experiments with mice with mTOR knockout in dendritic cells (mTOR$^{\Delta XCR1}$), mice with EPOR knockout in dendritic cells (EPOR$^{\Delta XCR1}$) can be performed, as shown in FIG. 38B. CD11c$^{Int}$MHCII$^{High}$XCR1$^+$cDC1s are collected from peripheral lymph nodes (pLN) of mice with mTOR knockout in dendritic cells (mTOR$^{\Delta XCR1}$), mice with EPOR knockout in dendritic cells (EPOR$^{\Delta XCR1}$), and their litter-mate controls. The cells are loaded with irradiated Ova-thy cells and cocultured with naïve OT-II cells with or without CEPO. Downstream analysis, such as flow cytometry analysis to measure FoxP3 expression and proliferation, is performed.

Example 33. Effect of EPOR on Peripheral Lymph Node (pLN) Migratory cDC1s

Peripheral lymph nodes (pLNs) were analyzed by flow cytometry from EpoR$^{tdt/+}$, Zbtb46$^{gfp/+}$EpoR$^{tdT/+}$, CCR7$^{-/-}$EpoR$^{tdT/+}$, Batf3$^{-/-}$EpoR$^{tdT/+}$, and wild type (WT) C57BL/6J mice to see whether EPOR was mainly expressed on migratory cDCs or resident cDCs. As shown in FIG. 35A, flow cytometry analysis revealed that for each mouse strains, EpoR-tdTomato was shown to be expressed by migratory cDCs (MHCII$_{high}$CD11$^{inter}$) and resident cDCs (MHC$^{inter}$CD11$^{high}$) but mostly in migratory cDCs. Similarly, histogram representation (FIG. 35B) showed EPOR expression in migratory and resident cDC1s of individual mouse strains. EPOR expressing cells on individual inguinal (10.5%), axillary (19.5%), branchial (10.4%), or superficial cervical (15.5%) lymph nodes was also quantified via flow cytometry, as shown in FIG. 35C. Furthermore, pLN migratory cDCs were gated as XCR1$^+$ cDC1s and XCR1$^-$ cDC2s, and further gated with EPOR and CD103 expression via flow cytometry analysis. As shown in FIG. 35D, compared to the expression of EpoR in XCR1$^+$ cDC1s of EpoR$^{tdt/+}$ and Zbtb46$^{gfp/+}$EpoR$^{tdT/+}$, there were decreased expression of EPOR in XCR1$^+$ cDC1s of CCR7$^{-/-}$ EpoR$^{tdT/+}$ and Batf3$^{-/-}$EpoR$^{tdT/+}$, suggesting that EPOR is mainly expressed on pLN migatory cDC1s in CCR7 and Batf3 dependent manners.

A different mouse strain was also created to analyze EPOR expression. As shown in FIG. 35E, EpoR$^-$ tdT-cre mice were cross bred with Rosa26-lox-Stop-lox-EYFP mice. EpoR–TdT-cre expression led to EYFP expression through floxing out the stop codon. pLN migratory cDC1s (MHCII$^{high}$CD11$^{inter}$XCR1$^+$) were gated for EYFP expression, via flow cytometry analysis, showing expression of EYEP and EPOR in pLN migratory cDC1s.

Next, peripheral lymph node migratory EpoR$^+$XCR1$^+$ cDC1s were characterized. As shown in the flow cytometry analysis in FIG. 36, peripheral lymph node migratory EpoR$^+$ XCR1$^+$ cDC1s expressed DEC205 (CD205) and CCR7. Expression of PD-L1, Tim3, Ax1 and CD131 on EpoR$^{high}$ migratory cDC1s versus EpoR$^{low}$ migratory cDCs was analyzed, as shown in the histogram in FIG. 36.

To see if peripheral lymph node migratory EpoR$^+$XCR1$^+$ cDC1s mediate Ag-specific Tregs, pLN migratory EpoR+ cDC1s and EpoR$^-$ cDC1s were first sorted by flow cytometry, as shown in FIG. 37A. 2×10$^4$ CD45.2$^+$ cDC1s were cocultured with 1×10$^5$ purified macrophages and a fluorescent dye for cell labeling (CellTrace™ Violet) labeled naïve CD45.1$^+$ OT-II cells. 100 ng/200 μl DEC-205-Ova were added as cDC1-specific targeting antigen or cell-associated antigen. TGFβ was also added with a concentration of 2 ng/ml. Next, cells with or without TGFβ treatment were analyzed for FoxP3 expression and proliferation using fluorescent dye (CellTrace™ Violet), via flow cytometry. As shown in FIG. 37B, OT-II (e.g., CD45.1$^+$CD3$^+$ TCRvα2$^+$ CD4$^+$CD8$^-$ cells) cultured with EpoR+ cDC1s with or without TGFβ displayed greater FoxP3 expression than OT-II cultured with EpoR$^-$ cDC1s. Quantification of both percent and mean or median fluorescence intensity (MFI) of FoxP3+ Tregs in live OT-II showed statistically significant increase of FoxP3+ Tregs with EpoR$^+$ cDC1s and TGFβ treatment compared to with EpoR+ cDC1s and TGFβ treatment.

Similar experiment was conducted with Gray irradiated Act-mOVA thymocytes and EPO treatment. 2×10$^4$ CD45.2$^+$ cDC1s were cocultured with 1×10$^5$ purified macrophages and a fluorescent dye for cell labeling (CellTrace™ Violet) labeled naïve CD45.1$^+$ OT-II cells. 4×10$^4$ 15 Gray irradiated Act-mOVA thymocytes (CD45.2$^+$) were added as cDC1-specific targeting antigen or cell-associated antigen. TGFβ was also added with a concentration of 2 ng/ml. EPO was added every day at a concentration of 40 IU/200 μl over the course of five consecutive days. At day 6, cells with or without TGFβ treatment and with or without EPO treatment were analyzed for FoxP3 expression and proliferation using fluorescent dye (CellTrace™ Violet), via flow cytometry. As shown in FIG. 37C, OT-II (e.g., CD45.1$^+$CD3$^+$ TCRvα2$^+$ CD4$^+$CD8$^-$ cells) cultured with EpoR+ cDC1s displayed greater FoxP3 expression than OT-II cultured with EpoR$^-$ cDC1s. Addition of EPO increased the percent and MFI of FoxP3+ Tregs in live OT-II cultured with EpoR– cDC1s to a level that was comparable to EpoR+ cDC1s with EPO. Collectively, the results suggest that peripheral lymph node migratory EpoR$^+$XCR1$^+$ cDC1s induced Ag-specific Tregs towards both DEC205-Ova and Ova-expressing cells.

Example 34. In Vivo Studies on Migratory cDCs and Effect of EPO on Peripheral Ag-Specific Tolerance Migratory cDCs were s.c. injected into the 3$^{rd}$ mammary fat pad into the draining lymph node of mice, as shown in the experimental scheme in FIG. 39A. The cDC1s of the 3$^{rd}$ mammary fat pad were collected and analyzed via flow cytometry. As shown in FIG. 39B, cDCs from 3$^{rd}$ mammary fat pad were gated as live-dead aqua$^-$CD11c$^+$Zbtb46$^+$. EPOR$^+$ cDC1s were gated within XCR1$^+$ cDC1s and CD103$^+$. Flow cytometry analysis showed that majority of the 3$^{rd}$ mammary fat pad cDC1s expressed EPOR (76.8%). To investigate the effect of migratory cDCs carrying apoptotic cells, PKH67 labeled CD45.1$^+$ dexamethasone (DEX)-induced apoptotic thymocytes were s.c. injected into the 3$^{rd}$ mammary fat pad. After 12 hours later, the draining lymph node (inguinal LN) was analyzed by flow cytometry. As shown in FIG. 39C, CD45.2$^+$CD45.1$^-$ host cells were gated, and PKH67 positive signal was found in migratory (MHCII$_{high}$CD11c$^{inter}$) and resident cDCs (MHCII$^{inter}$CD11c$^{high}$) versus EpoR expression. It was found that migratory cDCs carrying apoptotic cells expressed more EPOR compared to resident cDCs.

Effect of EPO was studied in vivo, as shown in FIG. 40A, by injecting i.v. 5×10$^5$ purified macrophages and a fluorescent dye for cell labeling (CellTrace™ Violet) labeled naïve CD45.1$^+$ OT-II cells at day −1. At day 0, Dexamethasone (DEX)-induced apoptotic Act-mOVA thymocytes were s.c. injected into the 3$^{rd}$ mammary fat pad. 50 IU EPO was given i.p. for over the course of 4 consecutive days. At day 4, CD45.1$^+$OT-II in the draining lymph node (inguinal LN) was analyzed by flow cytometry. As shown in FIG. 40B, OT-II from mice with or without EPO treatment were gated as CD45.1$^+$CD3$^+$ TCRvα2$^+$CD4$^+$CD8$^-$. OT-II was further gated for FoxP3 expression was versus CTV. Flow cytometry analysis revealed that with EPO, there was statistically significant increase in FoxP3+ cells (58.300 with EPO vs. 7.23% without EPO) and FoxP3 expression in adoptively transferred OT-II, as measured by percent of FoxP3+ cells and MFI, respectively. The results showed that EPO promoted the peripheral Ag-specific tolerance in the draining lymph node towards cell associated Ags (Ova). A similar experiment can be done with CEPO.

Sequences

TABLE 4

| | | | | | | | | Full HC AA sequence | Full LC AA sequence |
|---|---|---|---|---|---|---|---|---|---|
| clonotype_ id | fre- quency | VH Gene | VL Gene | VH-CDR3 AA | SEQ ID NO | VL-CDR3 AA | SEQ ID NO | SEQ ID NO | SEQ ID NO |
| clonotype 10 | 20 | IGHV6- 1 | IGLV2- 14 | CARKGELLGA FDIW | 63 | CSSYTSSSTWV F | 251 | 439 | 627 |
| clonotype 13 | 18 | IGHV6- 1 | IGLV2- 23 | CARKWELRDA FDIW | 64 | CCSYAGRSTLG IDWVF | 252 | 440 | 628 |
| clonotype 22 | 8 | IGHV3- 20 | IGLV3- 1 | CAREDYGDPG WFDPW | 65 | CQAWDSSTYVF | 253 | 441 | 629 |
| clonotype 31 | 6 | IGHV4- 39 | IGLV3- 27 | CATLTGDGDY W | 66 | CYSAADNNLVF | 254 | 442 | 630 |
| clonotype 33 | 6 | IGHV3- 21 | IGLV3- 19 | CARDRSSSWY SFDYW | 67 | CNSRDSSGNHR VF | 255 | 443 | 631 |
| clonotype 36 | 6 | IGHV3- 21 | IGLV2- 11 | CARDGITGTT FYFDYW | 68 | CCSYAGSYTWV F | 256 | 444 | 632 |
| clonotype 42 | 5 | IGHV3- 33 | IGLV2- 8 | CASIAAAGRD YW | 69 | CSSYAGSNNLV F | 257 | 445 | 633 |
| clonotype 43 | 5 | IGHV3- 23 | IGLV2- 14 | CAKAPELRFD YW | 70 | CSSYTSSSTYV F | 258 | 446 | 634 |
| clonotype 44 | 5 | IGHV1- 18 | IGLV2- 23 | CARNHYYYMD VW | 71 | CCSYAGSSTYV VF | 259 | 447 | 635 |
| clonotype 45 | 5 | IGHV4- 34 | IGLV3- 19 | CARGELGIGY WYFDLW | 72 | CNSRDSSGNHV VF | 260 | 448 | 636 |
| clonotype 47 | 4 | IGHV3- 33 | IGLV3- 21 | CARDTGITMV RGVFDYW | 73 | CQVWDSSSDHP VF | 261 | 449 | 637 |
| clonotype 56 | 4 | IGHV3- 73 | IGLV5- 45 | CNGVYGGSSY FFDYW | 74 | CMIWHSSAVVF | 262 | 450 | 638 |
| clonotype 58 | 3 | IGHV1- 2 | IGLV3- 19 | CARDETTIFD YW | 75 | CNSRDSSGNWV F | 263 | 451 | 639 |
| clonotype 62 | 3 | IGHV1- 18 | IGLV3- 10 | CARLGCNGTS CYTSWYYHFY MDVW | 76 | CYSTDSSGNHS WVF | 264 | 452 | 640 |
| clonotype 66 | 3 | IGHV3- 33 | IGLV2- 14 | CARDEDYYGS GSYSFDYW | 77 | CSSYTSSSTLV F | 265 | 453 | 641 |
| clonotype 69 | 3 | IGHV4- 4 | IGLV5- 45 | CARRGAARPF DYW | 78 | CMIWHSSAYVV F | 266 | 454 | 642 |
| clonotype 75 | 2 | IGHV2- 5 | IGLV3- 1 | CAHSNWNYGY FDLW | 79 | CQAWDSSTAWV F | 267 | 455 | 643 |

TABLE 4-continued

VH-CDR3 and VL-CDR3 Sequences for Anti-EPOR Antibodies

| clonotype_id | fre-quency | VH Gene | VL Gene | VH-CDR3 AA | SEQ ID NO | VL-CDR3 AA | SEQ ID NO | Full HC AA sequence SEQ ID NO | Full LC AA sequence SEQ ID NO |
|---|---|---|---|---|---|---|---|---|---|
| clonotype 80 | 2 | IGHV3-23 | IGLV3-10 | CAKKDIVATH FDYW | 80 | CYSTDSSGNHK VF | 268 | 456 | 644 |
| clonotype 82 | 2 | IGHV3-15 | IGLV3-19 | CTTADYDEWS GYYMDVW | 81 | CNSRDSSGNHW VF | 269 | 457 | 645 |
| clonotype 95 | 2 | IGHV3-48 | IGLV2-11 | CARDRYNFDY W | 82 | CCSYAGSSWVF | 270 | 458 | 646 |
| clonotype 99 | 2 | IGHV3-20 | IGLV2-14 | CARGGDTAMV TVFDYW | 83 | CSSYTSSSTLV F | 271 | 459 | 647 |
| clonotype 102 | 2 | IGHV5-51 | IGLV2-23 | CARQINWGAI DYW | 84 | CCSYAGSSTFV VF | 272 | 460 | 648 |
| clonotype 103 | 2 | IGHV1-18 | IGLV2-23 | CARQITATRG FDYW | 85 | CCSYAGSSTFV VF | 273 | 461 | 649 |
| clonotype 109 | 2 | IGHV6-1 | IGLV2-23 | CARKWELRDT FDIW | 86 | CCSYAGSSTLG IDWVF | 274 | 462 | 650 |
| clonotype 110 | 2 | IGHV4-34 | IGLV4-3 | CASYGDFFDY W | 87 | CGESHTIDGQV GVVF | 275 | 463 | 651 |
| clonotype 111 | 2 | IGHV3-21 | IGLV4-3 | CARETELTVM DVW | 88 | CGESHTIDGQV GWVF | 276 | 464 | 652 |
| clonotype 112 | 2 | IGHV3-15 | IGLV3-19 | CTTDWEYYDE WSGYYSPYFD YW | 89 | CNSRDSSGNHV VF | 277 | 465 | 653 |
| clonotype 397 | 1 | IGHV4-30-4 | IGLV3-21 | CARAFDYW | 90 | CQVWDSRSDHV VF | 278 | 466 | 654 |
| clonotype 398 | 1 | IGHV4-30-4 | IGLV3-21 | CVRAFDYW | 91 | CQVWDLYSAHV VF | 279 | 467 | 655 |
| clonotype 399 | 1 | IGHV3-15 | IGLV3-10 | CTTGANW | 92 | CYSTDSSGNHW VF | 280 | 468 | 656 |
| clonotype 400 | 1 | IGHV1-8 | IGLV2-14 | CARVAFDIW | 93 | CSSYTSSSTVFF | 281 | 469 | 657 |
| clonotype 401 | 1 | IGHV1-18 | IGLV2-8 | CARQIGDYW | 94 | CSAYAGSNNVV F | 282 | 470 | 658 |
| clonotype 402 | 1 | IGHV3-23 | IGLV1-44 | CHQTGEDYW | 95 | CAAWDDSLNGW VF | 283 | 471 | 659 |
| clonotype 407 | 1 | IGHV3-15 | IGLV3-25 | CTTGGTHW | 96 | CQSADSSATWV F | 284 | 472 | 660 |
| clonotype 408 | 1 | IGHV1-8 | IGLV3-10 | CARRSFLDYW | 97 | CYSTDSSGNHR VF | 285 | 473 | 661 |
| clonotype 409 | 1 | IGHV3-15 | IGLV3-25 | CTTGGTNW | 98 | CQSLDSSGTYW VF | 286 | 474 | 662 |
| clonotype 413 | 1 | IGHV3-21 | IGLV3-1 | CARESSGFDY W | 99 | CQAWDSSTVVF | 287 | 475 | 663 |
| clonotype 414 | 1 | IGHV1-8 | IGLV3-1 | CARGSSWFDY W | 100 | CQAWDSSTVVF | 288 | 476 | 664 |
| clonotype 415 | 1 | IGHV3-15 | IGLV3-1 | CTLNWGDYW | 101 | CQAWDSSTVVF | 289 | 477 | 665 |
| clonotype 418 | 1 | IGHV3-21 | IGLV3-19 | CARAADAFDI W | 102 | CNSRDSSGNHW VF | 290 | 478 | 666 |
| clonotype 419 | 1 | IGHV3-13 | IGLV2-23 | CARGGSDAFD IW | 103 | CCSYAGSVVF | 291 | 479 | 667 |

TABLE 4-continued

VH-CDR3 and VL-CDR3 Sequences for Anti-EPOR Antibodies

| clonotype_id | fre-quency | VH Gene | VL Gene | VH-CDR3 AA | SEQ ID NO | VL-CDR3 AA | SEQ ID NO | Full HC AA sequence SEQ ID NO | Full LC AA sequence SEQ ID NO |
|---|---|---|---|---|---|---|---|---|---|
| clonotype 420 | 1 | IGHV3-15 | IGLV3-19 | CTTDHPYYW | 104 | CNSRDSSGNHV VF | 292 | 480 | 668 |
| clonotype 421 | 1 | IGHV3-15 | IGLV3-19 | CTTDHPYYW | 105 | CNSRDSSGNHW VF | 293 | 481 | 669 |
| clonotype 423 | 1 | IGHV3-33 | IGLV1-36 | CALAVTGFDY W | 106 | CAAWDDRINGP VF | 294 | 482 | 670 |
| clonotype 424 | 1 | IGHV3-11 | IGLV2-23 | CARDGAAFDI W | 107 | CCSYAGSSTLV F | 295 | 483 | 671 |
| clonotype 426 | 1 | IGHV1-18 | IGLV3-1 | CARDRGYSFD YW | 108 | CQAWDSSTF | 296 | 484 | 672 |
| clonotype 427 | 1 | IGHV1-18 | IGLV3-27 | CARNHYYYLD VW | 109 | CYSAADNNRVF | 297 | 485 | 673 |
| clonotype 428 | 1 | IGHV3-13 | IGLV3-27 | CARVSPTGTT DYW | 110 | CYSAADNNLVF | 298 | 486 | 674 |
| clonotype 429 | 1 | IGHV3-15 | IGLV3-27 | CTARPLGDVW | 111 | CYSAADNNYVF | 299 | 487 | 675 |
| clonotype 430 | 1 | IGHV3-15 | IGLV3-27 | CTTDNGFDYW | 112 | CYSAADNNLVF | 300 | 488 | 676 |
| clonotype 431 | 1 | IGHV3-21 | IGLV3-19 | CARDLISSFD YW | 113 | CNSRDSSGNHL VF | 301 | 489 | 677 |
| clonotype 432 | 1 | IGHV3-7 | IGLV3-19 | CARRIVGAFD YW | 114 | CNSRDSSGNHL VF | 302 | 490 | 678 |
| clonotype 434 | 1 | IGHV1-46 | IGLV3-21 | CARGGWGTMD VW | 115 | CQVWDSSSDHV VF | 303 | 491 | 679 |
| clonotype 435 | 1 | IGHV3-48 | IGLV3-10 | CAREGWELLD YW | 116 | CYSTDSSGNHR VF | 304 | 492 | 680 |
| clonotype 436 | 1 | IGHV3-53 | IGLV7-43 | CARDNWDSYF DYW | 117 | CLLYYGGARVF | 305 | 493 | 681 |
| clonotype 437 | 1 | IGHV3-20 | IGLV2-8 | CARTTVTHMD VW | 118 | CSSYAGSNNLV F | 306 | 494 | 682 |
| clonotype 438 | 1 | IGHV3-53 | IGLV2-23 | CARDWNYDAF DIW | 119 | CCSYAGSSTWV F | 307 | 495 | 683 |
| clonotype 439 | 1 | IGHV3-21 | IGLV2-23 | CARGDPGWFD PW | 120 | CCSYAGSSTFW VF | 308 | 496 | 684 |
| clonotype 442 | 1 | IGHV3-74 | IGLV3-1 | CARENWNYWF DPW | 121 | CQAWDSSTVVF | 309 | 497 | 685 |
| clonotype 443 | 1 | IGHV4-4 | IGLV3-1 | CARLRPGDSF DYW | 122 | CQAWDSSTALV F | 310 | 498 | 686 |
| clonotype 444 | 1 | IGHV7-4-1 | IGLV3-1 | CARSPNWGLF DYW | 123 | CQAWDSSTSGV F | 311 | 499 | 687 |
| clonotype 445 | 1 | IGHV3-21 | IGLV3-19 | CARDRGATGF DYW | 124 | CNSRDSSGNHW VF | 312 | 500 | 688 |
| clonotype 446 | 1 | IGHV1-18 | IGLV3-10 | CARESGELLG DYW | 125 | CYSTDSSGNHR VF | 313 | 501 | 689 |
| clonotype 448 | 1 | IGHV3-13 | IGLV3-19 | CARYSGSYYY FDYW | 126 | CNSRDSSGNHV VF | 314 | 502 | 690 |
| clonotype 450 | 1 | IGHV3-33 | IGLV3-10 | CARGIAAAGK DYW | 127 | CYSTDSSGNHA VF | 315 | 503 | 691 |

TABLE 4-continued

VH-CDR3 and VL-CDR3 Sequences for Anti-EPOR Antibodies

| clonotype_ id | fre- quency | VH Gene | VL Gene | VH-CDR3 AA | SEQ ID NO | VL-CDR3 AA | SEQ ID NO | Full HC AA sequence SEQ ID NO | Full LC AA sequence SEQ ID NO |
|---|---|---|---|---|---|---|---|---|---|
| clonotype 451 | 1 | IGHV-5 51 | IGLV3- 21 | CARQDSNYVF DYW | 128 | CQVWDSSSDHV VF | 316 | 504 | 692 |
| clonotype 452 | 1 | IGHV3- 7 | IGLV1- 44 | CARDHSAWSF DYW | 129 | CATWDDSLNGR VF | 317 | 505 | 693 |
| clonotype 453 | 1 | IGHV3- 7 | IGLV2- 8 | CARRRGSCSF DYW | 130 | CSSYAGSNNLV F | 318 | 506 | 694 |
| clonotype 454 | 1 | IGHV1- 18 | IGLV2- 8 | CARRSYANCF DYW | 131 | CSSYAGSNNWV F | 319 | 507 | 695 |
| clonotype 455 | 1 | IGHV3- 74 | IGLV2- 23 | CARDEQLVPF DIW | 132 | CCSYAGSSTLV F | 320 | 508 | 696 |
| clonotype 456 | 1 | IGHV3- 53 | IGLV2- 23 | CARDGAAAGD FQHW | 133 | CCSYAGSSTWV F | 321 | 509 | 697 |
| clonotype 457 | 1 | IGHV3- 43 | IGLV2- 8 | CAKDSGSYYF DYW | 134 | CSSYAGSNNFV VF | 322 | 510 | 698 |
| clonotype 458 | 1 | IGHV3- 11 | IGLV1- 40 | CARDGQLWSF DYW | 135 | CQSYDSSLSDV VF | 323 | 511 | 699 |
| clonotype 459 | 1 | IGHV3- 53 | IGLV1- 40 | CGRVVPIGNW FDPW | 136 | CQSYDSSLSGW VF | 324 | 512 | 700 |
| clonotype 460 | 1 | IGHV3- 7 | IGLV5- 45 | CARDSNWGVF DYW | 137 | CMIWHSSAWVF | 325 | 513 | 701 |
| clonotype 461 | 1 | IGHV3- 7 | IGLV5- 45 | CARDRLTGDL DYW | 138 | CMIWHSSAWVF | 326 | 514 | 702 |
| clonotype 464 | 1 | IGHV3- 74 | IGLV3- 9 | CAREGDRSDA FAIW | 139 | CQVWDSSGSWV F | 327 | 515 | 703 |
| clonotype 465 | 1 | IGHV3- 21 | IGLV3- 10 | CARQQWLGYY FDYW | 140 | CYSTDSSGNHR VF | 328 | 516 | 704 |
| clonotype 466 | 1 | IGHV3- 7 | IGLV3- 19 | CARDSNFLYY FDYW | 141 | CNSRDTSGNYL VF | 329 | 517 | 705 |
| clonotype 468 | 1 | IGHV1- 18 | IGLV3- 19 | CARQITGTRG FDYW | 142 | CNSRDSSGNHW VF | 330 | 518 | 706 |
| clonotype 469 | 1 | IGHV1- 8 | IGLV3- 10 | CARMGYSNYP FDYW | 143 | CYSTDSSGNHV VF | 331 | 519 | 707 |
| clonotype 470 | 1 | IGHV1- 46 | IGLV3- 19 | CARGIPTTVT PDYW | 144 | CNSRDSSGNHL VF | 332 | 520 | 708 |
| clonotype 471 | 1 | IGHV3- 13 | IGLV3- 10 | CARAGLLTGD AFDIW | 145 | CYSTDSSGNHR VF | 333 | 521 | 709 |
| clonotype 474 | 1 | IGHV3- 15 | IGLV7- 43 | CITGTTFPFD YW | 146 | CLLYYGGAWVF | 334 | 522 | 710 |
| clonotype 475 | 1 | IGHV3- 64 | IGLV2- 14 | CTKGGVGASF DYW | 147 | CSSYTSSSTWV F | 335 | 523 | 711 |
| clonotype 476 | 1 | IGHV3- 21 | IGLV1- 44 | CARGDYSNYY FDYW | 148 | CAAWDDSLNGW VF | 336 | 524 | 712 |
| clonotype 477 | 1 | IGHV4- 34 | IGLV2- 8 | CARWEQPW | 149 | CSSYAGSNNWV F | 337 | 525 | 713 |
| clonotype 478 | 1 | IGHV1- 46 | IGLV2- 23 | CARRTGTTHY FDYW | 150 | CCSYAGSSTLV F | 338 | 526 | 714 |
| clonotype 479 | 1 | IGHV3- 11 | IGLV2- 23 | CARGLWLGLY FDYW | 151 | CCSYAGSSTWV F | 339 | 527 | 715 |

TABLE 4-continued

VH-CDR3 and VL-CDR3 Sequences for Anti-EPOR Antibodies

| clonotype_ id | fre- quency | VH Gene | VL Gene | VH-CDR3 AA | SEQ ID NO | VL-CDR3 AA | SEQ ID NO | Full HC AA sequence SEQ ID NO | Full LC AA sequence SEQ ID NO |
|---|---|---|---|---|---|---|---|---|---|
| clonotype 480 | 1 | IGHV5- 51 | IGLV2- 8 | CARFLGSSYY FDYW | 152 | CSSYAGSNNFE VF | 340 | 528 | 716 |
| clonotype 481 | 1 | IGHV3- 48 | IGLV5- 45 | CARGGAAAGA FDIW | 153 | CMIWHSSAWVF | 341 | 529 | 717 |
| clonotype 486 | 1 | IGHV4- 30-4 | IGLV3- 1 | CARAEWELLW FDPW | 154 | CQAWDSSTVVF | 342 | 530 | 718 |
| clonotype 487 | 1 | IGHV2- 5 | IGLV3- 25 | CAHNYFYISG YFYW | 155 | CQSANSGTWVF | 343 | 531 | 719 |
| clonotype 488 | 1 | IGHV3- 30 | IGLV3- 1 | CAKDPLRVVN YMDVW | 156 | CQAWDSSTVVF | 344 | 532 | 720 |
| clonotype 490 | 1 | IGHV2- 5 | IGLV3- 25 | CAQTGYNSWS FDYW | 157 | CQSADSSGTWV F | 345 | 533 | 721 |
| clonotype 492 | 1 | IGHV1- 18 | IGLV3- 19 | CAREDAWNYG WFDPW | 158 | CNSRDSSGNHV VF | 346 | 534 | 722 |
| clonotype 493 | 1 | IGHV1- 18 | IGLV3- 10 | CAREILWLGG YFDYW | 159 | CYSTDSSGNHR VF | 347 | 535 | 723 |
| clonotype 494 | 1 | IGHV7- 4-1 | IGLV3- 19 | CAREYSSGWY YFDYW | 160 | CNSRDSSGNHL VF | 348 | 536 | 724 |
| clonotype 495 | 1 | IGHV1- 2 | IGLV3- 10 | CARERIAVAP PFDYW | 161 | CYSTDSSGNHR VF | 349 | 537 | 725 |
| clonotype 496 | 1 | IGHV1- 8 | IGLV3- 10 | CARAGWELPE YFQHW | 162 | CYSTDSSGNHR VF | 350 | 538 | 726 |
| clonotype 497 | 1 | IGHV1- 8 | IGLV3- 10 | CARGGDDYSN LFDYW | 163 | CYSTDSSGNHR VF | 351 | 539 | 727 |
| clonotype 498 | 1 | IGHV1- 69D | IGLV3- 21 | CARTPLGIGR SFDLW | 164 | CQVWDSNSDHW VF | 352 | 540 | 728 |
| clonotype 499 | 1 | IGHV3- 15 | IGLV3- 25 | CTTASTVTTG DYW | 165 | CQSADSSGTYP VF | 353 | 541 | 729 |
| clonotype 501 | 1 | IGHV6- 1 | IGLV3- 19 | CARERTEIDY W | 166 | CNSRDSSGNHW VF | 354 | 542 | 730 |
| clonotype 502 | 1 | IGHV3- 15 | IGLV7- 46 | CTTGRYFDWF DYW | 167 | CLLSYSGARVF | 355 | 543 | 731 |
| clonotype 504 | 1 | IGHV3- 15 | IGLV2- 8 | CTTASGSYWF DPW | 168 | CSSYAGSNNLV F | 356 | 544 | 732 |
| clonotype 505 | 1 | IGHV3- 30 | IGLV2- 23 | CAKGNWNYGD AFDIW | 169 | CCSYAGSSTYV F | 357 | 545 | 733 |
| clonotype 506 | 1 | IGHV3- 20 | IGLV2- 14 | CARENYDEWS GFDPW | 170 | CSSYTSSSTVV F | 358 | 546 | 734 |
| clonotype 507 | 1 | IGHV6- 1 | IGLV2- 23 | CAREDRGFDY W | 171 | CCSYAGSSNVV F | 359 | 547 | 735 |
| clonotype 508 | 1 | IGHV3- 43 | IGLV2- 23 | CAKRAVVTDY YMDVW | 172 | CCSYAGSSTFW VF | 360 | 548 | 736 |
| clonotype 509 | 1 | IGHV3- 48 | IGLV2- 8 | CARTSSWSYD AFDIW | 173 | CSSYAGSNNFV VF | 361 | 549 | 737 |
| clonotype 511 | 1 | IGHV1- 46 | IGLV3- 1 | CARERGHTVT PYFDYW | 174 | CQATEVF | 362 | 550 | 738 |
| clonotype 512 | 1 | IGHV3- 48 | IGLV3- 27 | CARDGPQVGA TDEDYW | 175 | CYSAADNKVF | 363 | 551 | 739 |

TABLE 4-continued

| | | | | | | | | Full HC AA sequence | Full LC AA sequence |
| clonotype_ id | fre- quency | VH Gene | VL Gene | VH-CDR3 AA | SEQ ID NO | VL-CDR3 AA | SEQ ID NO | SEQ ID NO | SEQ ID NO |
| --- | --- | --- | --- | --- | --- | --- | --- | --- | --- |
| clonotype 513 | 1 | IGHV3- 15 | IGLV3- 1 | CTTEYSSSEN FDYW | 176 | CQAWDSSTAVF | 364 | 552 | 740 |
| clonotype 514 | 1 | IGHV3- 74 | IGLV3- 1 | CARDLGAARP RGFDYW | 177 | CQAWDSSTVVF | 365 | 553 | 741 |
| clonotype 515 | 1 | IGHV3- 23 | IGLV3- 10 | CAKEGDSGYD SAFDIW | 178 | CYSTDSSGNRV F | 366 | 554 | 742 |
| clonotype 517 | 1 | IGHV4- 4 | IGLV3- 10 | CARVLNWNYG DAFDIW | 179 | CYSTDSSGNHR GF | 367 | 555 | 743 |
| clonotype 518 | 1 | IGHV4- 4 | IGLV2- 11 | CARDPSIVGA TAFDIW | 180 | CCSYAQGVVF | 368 | 556 | 744 |
| clonotype 519 | 1 | IGHV4- 4 | IGLV3- 19 | CARSHIVGVN GGFDYW | 181 | CNSRDSSGNHW VF | 369 | 557 | 745 |
| clonotype 520 | 1 | IGHV3- 21 | IGLV3- 19 | CARDRYNWNY RAFDIW | 182 | CNSRDSSGNHL VF | 370 | 558 | 746 |
| clonotype 522 | 1 | IGHV3- 7 | IGLV3- 19 | CARDLGRGTI SWFDPW | 183 | CNSRDSSGNHW VF | 371 | 559 | 747 |
| clonotype 523 | 1 | IGHV2- 5 | IGLV3- 21 | CTQTGYDSRW SFAYW | 184 | CQVWDSSSDHW VF | 372 | 560 | 748 |
| clonotype 524 | 1 | IGHV1- 18 | IGLV3- 19 | CAREGQWRGR GWFALW | 185 | CNSRDSSGNHL VF | 373 | 561 | 749 |
| clonotype 526 | 1 | IGHV7- 4-1 | IGLV3- 19 | CARERYFEDF HYMDVW | 186 | CNSRDSSGNHL VF | 374 | 562 | 750 |
| clonotype 527 | 1 | IGHV1- 2 | IGLV3- 19 | CARSSWLQLT YYFDYW | 187 | CNSRDSSGNHL LF | 375 | 563 | 751 |
| clonotype 528 | 1 | IGHV1- 46 | IGLV3- 19 | CAREGLQLGS NWFDPW | 188 | CKSRDSSGNHV VF | 376 | 564 | 752 |
| clonotype 529 | 1 | IGHV3- 48- | IGLV3- 10 | CARNDILTGE DAFDIW | 189 | CYSTDSSGNHR VF | 377 | 565 | 753 |
| clonotype 530 | 1 | IGHV3- 23 | IGLV3- 19 | CAKESIIVGA TMFDYW | 190 | CNSRDSSGNHW VF | 378 | 566 | 754 |
| clonotype 531 | 1 | IGHV3- 30 | IGLV3- 19 | CAKGIAALGY YYMDVW | 191 | CNSRDSSGNHL VF | 379 | 567 | 755 |
| clonotype 532 | 1 | IGHV5- 51 | IGLV3- 19 | CAKRRITGSH NWFDPW | 192 | CNSRDSSGNHL VF | 380 | 568 | 756 |
| clonotype 534 | 1 | IGHV7- 4-1 | IGLV7- 43 | CARGGTIFGV VNFDYW | 193 | CLLYYGGARVF | 381 | 569 | 757 |
| clonotype 537 | 1 | IGHV3- 33 | IGLV2- 23 | CLSRSGYSAH NDGDYW | 194 | CCSYAGSSTWV F | 382 | 570 | 758 |
| clonotype 538 | 1 | IGHV1- 2 | IGLV1- 40 | CTKEGLVVRP DWFDPW | 195 | CQSYDSSLSGP VF | 383 | 571 | 759 |
| clonotype 539 | 1 | IGHV6- 1 | IGLV2- 23 | CARKGRDVFD IW | 196 | CCSYAGSSTYW VF | 384 | 572 | 760 |
| clonotype 540 | 1 | IGHV1- 18 | IGLV1- 40 | CAREGSGSYS DAFDIW | 197 | CQSYDSSLSGS YVF | 385 | 573 | 761 |
| clonotype 541 | 1 | IGHV2- 5 | IGLV5- 45 | CTHTEYRNTW CVDYW | 198 | CMIWHSSAIVF | 386 | 574 | 762 |
| clonotype 542 | 1 | IGHV2- 5 | IGLV5- 45 | CAHSPYTSGW PFDYW | 199 | CMIWHSSASVF | 387 | 575 | 763 |

TABLE 4-continued

<div align="center">VH-CDR3 and VL-CDR3 Sequences for Anti-EPOR Antibodies</div>

| clonotype_ id | fre- quency | VH Gene | VL Gene | VH-CDR3 AA | SEQ ID NO | VL-CDR3 AA | SEQ ID NO | Full HC AA sequence SEQ ID NO | Full LC AA sequence SEQ ID NO |
|---|---|---|---|---|---|---|---|---|---|
| clonotype 543 | 1 | IGHV1- 8 | IGLV5- 45 | CARVSYSSSW SLFDYW | 200 | CMIWHSSAWVF | 388 | 576 | 764 |
| clonotype 548 | 1 | IGHV2- 70 | IGLV3- 19 | CARIRGVGAL DGFDFW | 201 | CNSRDSSGNHL VF | 389 | 577 | 765 |
| clonotype 549 | 1 | IGHV1- 18 | IGLV3- 19 | CARPLDYGDY EGWFDPW | 202 | CNSRDSSGNHL VF | 390 | 578 | 766 |
| clonotype 550 | 1 | IGHV1- 18 | IGLV3- 19 | CAREGRTNYF YYYMDVW | 203 | CNSRDSSGNHW VF | 391 | 579 | 767 |
| clonotype 552 | 1 | IGHV3- 43 | IGLV3- 19 | CAKDITASGD YYYMDVW | 204 | CNSRDSSGNHL VF | 392 | 580 | 768 |
| clonotype 553 | 1 | IGHV3- 48 | IGLV3- 19 | CARDRVYNWN DGAFDIW | 205 | CNSRDSSGNHV VF | 393 | 581 | 769 |
| clonotype 554 | 1 | IGHV3- 23 | IGLV3- 19 | CAKDQRYNWN SWYFDLW | 206 | CNSRDSSGNHL VF | 394 | 582 | 770 |
| clonotype 555 | 1 | IGHV3- 33 | IGLV3- 10 | CARDHGGVTT YNWFDPW | 207 | CYSTDSSGNHR VF | 395 | 583 | 771 |
| clonotype 559 | 1 | IGHV1- 2 | IGLV2- 8 | CARDRMVRGV LDAFDIW | 208 | CSSYAGSNNVV F | 396 | 584 | 772 |
| clonotype 560 | 1 | IGHV3- 48 | IGLV2- 8 | CVRGYSSGWY NWYFDLW | 209 | CSSYAGSNNLV F | 397 | 585 | 773 |
| clonotype 561 | 1 | IGHV3- 11 | IGLV7- 43 | CARKVPGIAA AGAFDYW | 210 | CLLYYGGAQLV F | 398 | 586 | 774 |
| clonotype 562 | 1 | IGHV7- 4-1 | IGLV1- 40 | CARGGYGYNF WIRFDPW | 211 | CQSYDNSLSGS VF | 399 | 587 | 775 |
| clonotype 568 | 1 | IGHV4- 39 | IGLV3- 27 | CASYWNFDYW | 212 | CYSAADNNLVF | 400 | 588 | 776 |
| clonotype 569 | 1 | IGHV4- 4 | IGLV3- 10 | CARVLGYSYG YRRWFDPW | 213 | CYSTDSSGNHR VF | 401 | 589 | 777 |
| clonotype 573 | 1 | IGHV3- 15 | IGLV3- 21 | CTTEGSFNFY YFMDVW | 214 | CQVWDSTSDHY VF | 402 | 590 | 778 |
| clonotype 576 | 1 | IGHV4- 59 | IGLV2- 23 | CARDPFYYDF SDYYYMDVW | 215 | CCSYAGTISWV F | 403 | 591 | 779 |
| clonotype 577 | 1 | IGHV3- 23 | IGLV2- 23 | CAKNEARDYY GSGSFDYW | 216 | CCSYAGSSTYV F | 404 | 592 | 780 |
| clonotype 578 | 1 | IGHV3- 20 | IGLV2- 8 | CASLVGATDY YFYYMDVW | 217 | CSSYAGSNNWV F | 405 | 593 | 781 |
| clonotype 579 | 1 | IGHV6- 1 | IGLV2- 23 | CARKWELLDA FDIW | 218 | CCSYAGSSTWV F | 406 | 594 | 782 |
| clonotype 581 | 1 | IGHV3- 48 | IGLV1- 40 | CAREERDDYS NYGYFQHW | 219 | CQSYDSSLSGW VF | 407 | 595 | 783 |
| clonotype 582 | 1 | IGHV6- 1 | IGLV2- 18 | CARGDWNYGV LDSW | 220 | CSSYTSSSTYV VF | 408 | 596 | 784 |
| clonotype 583 | 1 | IGHV1- 18 | IGLV1- 40 | CARSGYNWNY DYYFMDVW | 221 | CQSYDISLSGS VVF | 409 | 597 | 785 |
| clonotype 586 | 1 | IGHV3- 20 | IGLV3- 1 | CARDGCSSTS CYGNWFDPW | 222 | CQAWDSSTAVF | 410 | 598 | 786 |
| clonotype 587 | 1 | IGHV6- 1 | IGLV3- 10 | CARVDFGIVG AIDYW | 223 | CYSTDSSGKIF | 411 | 599 | 787 |

TABLE 4-continued

| | | | | | | | | Full HC AA sequence | Full LC AA sequence |
|---|---|---|---|---|---|---|---|---|---|
| clonotype_ id | fre- quency | VH Gene | VL Gene | VH-CDR3 AA | SEQ ID NO | VL-CDR3 AA | SEQ ID NO | SEQ ID NO | SEQ ID NO |
| clonotype 588 | 1 | IGHV3- 21 | IGLV3- 19 | CARDRDDEWS GYSPYFDYW | 224 | CNSRDSSGNHW VF | 412 | 600 | 788 |
| clonotype 589 | 1 | IGHV3- 21 | IGLV3- 19 | CAREKYDILT GYSPYFDYW | 225 | CNSRDSSGNHW VF | 413 | 601 | 789 |
| clonotype 596 | 1 | IGHV3- 15 | IGLV3- 10 | CTTDQVSGSY GDAFDIW | 226 | CYSTDSSGNHR VF | 414 | 602 | 790 |
| clonotype 598 | 1 | IGHV3- 23 | IGLV3- 19 | CAKRAGSGTY YRGYYFDYW | 227 | CNSRDSSGNHW VF | 415 | 603 | 791 |
| clonotype 599 | 1 | IGHV3- 33 | IGLV3- 19 | CAGTYYYDSS GYLNYMDVW | 228 | CNSRDSSGNHL VF | 416 | 604 | 792 |
| clonotype 600 | 1 | IGHV4- 39 | IGLV3- 19 | CASEGPYFDY W | 229 | CNSRDSSGNHW VF | 417 | 605 | 793 |
| clonotype 601 | 1 | IGHV1- 18 | IGLV2- 14 | CARAYCGGDC YYSNAFDAW | 230 | CSSYTSSSTVV F | 418 | 606 | 794 |
| clonotype 602 | 1 | IGHV3- 15 | IGLV2- 23 | CTTDRVTIFG LARMDVW | 231 | CCSYAGSSTWV F | 419 | 607 | 795 |
| clonotype 607 | 1 | IGHV3- 48 | IGLV3- 19 | CARDPTTIFG VVPYYYMDVW | 232 | CYSRDSSGNHL VF | 420 | 608 | 796 |
| clonotype 608 | 1 | IGHV3- 15 | IGLV3- 21 | CTTDRDYYGS GSYYFDYW | 233 | CQVWDSSSDHR VF | 421 | 609 | 797 |
| clonotype 610 | 1 | IGHV4- 39 | IGLV3- 19 | CAREDLIGND YW | 234 | CNSRDSSGNHL VF | 422 | 610 | 798 |
| clonotype 611 | 1 | IGHV6- 1 | IGLV3- 19 | CSRDRLIVGA SYFDLW | 235 | CNSRDSNGNHW VF | 423 | 611 | 799 |
| clonotype 612 | 1 | IGHV3- 20 | IGLV2- 23 | CAREKAPAHR SSWSWYFDLW | 236 | CCSYAGSSWVE | 424 | 612 | 800 |
| clonotype 613 | 1 | IGHV1- 2 | IGLV1- 40 | CTREGIAAAN PGYFYYMDVW | 237 | CQSYDGTLGGW IF | 425 | 613 | 801 |
| clonotype 616 | 1 | IGHV1- 2 | IGLV3- 19 | CARCDMVRGV IDHYYNYMDV W | 238 | CNSRDSSGNHW VF | 426 | 614 | 802 |
| clonotype 617 | 1 | IGHV4- 61 | IGLV2- 23 | CVRQTYDSWT GYSFFYFDYW | 239 | CCSYAGSSWVF | 427 | 615 | 803 |
| clonotype 622 | 1 | IGHV3- 73 | IGLV3- 1 | CTRPMITFGG VIVYDAFDIW | 240 | CQAWDSSTVIF | 428 | 616 | 804 |
| clonotype 625 | 1 | IGHV4- 34 | IGLV3- 10 | CARGWGSSSW YYFDYW | 241 | CYSTDSSGNHR VF | 429 | 617 | 805 |
| clonotype 626 | 1 | IGHV4- 34 | IGLV3- 19 | CARGIFGVGG NWFDPW | 242 | CNSRDSSGNHL VF | 430 | 618 | 806 |
| clonotype 629 | 1 | IGHV4- 39 | IGLV2- 8 | CARYSSSWSG FDYW | 243 | CSSYAGSNNF | 431 | 619 | 807 |
| clonotype 630 | 1 | IGHV4- 39 | IGLV3- 19 | CARGGSYYVY FDYW | 244 | CNSRDSSGNHW VF | 432 | 620 | 808 |
| clonotype 634 | 1 | IGHV3- 7 | IGLV3- 21 | CSRDTDCSST SCYFNWNPFF DYW | 245 | CQVWDSSSDHV VF | 433 | 621 | 809 |
| clonotype 638 | 1 | IGHV4- 39 | IGLV3- 1 | CARGGYSYGL NWFDPW | 246 | CQAWDSSTVVF | 434 | 622 | 810 |

TABLE 4-continued

| clonotype_ id | fre- quency | VH Gene | VL Gene | VH-CDR3 AA | SEQ ID NO | VL-CDR3 AA | SEQ ID NO | Full HC AA sequence SEQ ID NO | Full LC AA sequence SEQ ID NO |
|---|---|---|---|---|---|---|---|---|---|
| clonotype 641 | 1 | IGHV4- 39 | IGLV3- 19 | CARTYYDEWS GYLNWFDPW | 247 | CNSRDSSGNHV VF | 435 | 623 | 811 |
| clonotype 644 | 1 | IGHV4- 34 | IGLV2- 8 | CARWRNYYDS SGSPYWYFDL W | 248 | CSSYAGSNNWV F | 436 | 624 | 812 |
| clonotype 646 | 1 | IGHV4- 39 | IGLV2- 14 | CARQGRITMV RGVIPFDYW | 249 | CSSYTSSSTLV F | 437 | 625 | 813 |
| clonotype 647 | 1 | IGHV4- 34 | IGLV7- 46 | CAGGYCSSTS CRYNWNYGGW FDPW | 250 | CLLSYSGARVF | 438 | 626 | 814 |

TABLE 5

Full Heavy Chain (HC) and Light Chain (LC) Sequences for Anti-EPOR Antibodies

| SEQ ID NO | Full HC AA sequence | SEQ ID NO | Full LC AA sequence |
|---|---|---|---|
| 439 | QVQLQQSGPGLVKPSQTLSLTCAISGDSVSS NSAAWNWIRQSPSRGLEWLGRTYYRSKWYND YAVSVKSRITINPDTSKNQFSLQLNSVTPED TAVYYCARKGELLGAFDIWGQGTMVTVSS | 627 | QSALTQPASVSGSPGQSITISCTGTSSDVGG YNYVSWYQQHPGKAPKLMIYEVSNRPSGVSN RFSGSKSGNTASLTISGLQAEDEADYYCSSY TSSSTWVFGGGTKLTVL |
| 440 | QVQLQQSGPGLVKPSQTLSLTCAISGDSVSS NSAAWNWIRQSPSRGLEWLGRTYYRSKWYND YAGSVKSRIIIIPDTSKNQLSLQLKSVTPED TAVYYCARKWELRDAFDIWGQGTMVTVSS | 628 | QSALTQPASVSGSPGQSITISCTGTSSDVGG YNYVSWYQQHPGKAPKLMIYEVSKRPSGVSN RFSGSKSGNTASLTISGLQAEDEADYYCCSY AGRSTLGIDWVFGGGTKVTVL |
| 441 | EVQLVESGGSVVRPGGSLRLSCAASGFTFDD YGMSWVRQAPGKGLEWVSGINWNGGSTGYAD SVKGRFTISRDNAKNSLYLQMNSLRAEDTAL YYCAREDYGDPGWFDPWGQGTLVTVSS | 629 | SYELTQPPSVSVSPGQTASITCSGDKLGDKY ACWYQQKPGQSPVLVIYQDSKRPSGIPERFS GSNSGNTATLTISGTQAMDEADYYCQAWDSS TYVFGTGTKVTVL |
| 442 | QLQLQESGPGLVKPSETLSLTCTVSGGSISS SSYYWGWIRQPPGKGLEWIGSIYYSGSTYYN PSLKSRVTISVDTSKNQFSLKLSSVTAADTA VYYCATLTGDGDYWGQGTLVTVSS | 630 | SYELTQPSSVSVSPGQTARITCSGDVLAKKY ARWFQQKPGQAPVLVIYKDSERPSGIPERFS GSSSGTTVTLTISGAQVEDEADYYCYSAADN NLVFGGGTKLTVL |
| 443 | EVQLVESGGGLVKPGGSLRLSCAASGFTFSS YSMNWVRQAPGKGLEWVSSISSSSSYIYYAD SVKGRFTISRDNAKNSLYLQMNSLRAEDTAV YYCARDRSSSWYSFDYWGQGTLVTVSS | 631 | SSELTQDPAVSVALGQTVRITCQGDSLRSYY ASWYQQKPGQAPVLVIYGKNNRPSGIPDRFS GSSSGNTASLTITGAQAEDEADYYCNSRDSS GNHRVFGGGTKLTVL |
| 444 | EVQLVESGGGLVTPGGSLRLSCAASGFTFNN YSMNWVRQAPGKGLEWVSSISSSSSYIYYAD SVKGRFTISRDNAKNSLYLPMISLRAEDTAV YYCARDGITGTTFYFDYWGQGTLVTVSS | 632 | QSALTQPRSVSGSPGQSVTISCTGTSSDVGG YNYVSWYQQHPGKAPKLMIYDVSKRPSGVPD RFSGSKSGNTASLTISGLQAEDEADYYCCSY AGSYTWVFGGGTKLTVL |
| 445 | QVQLVESGGGVVQPGRSLRLSCAASGFTFSS YGMHWVRQAPGKGLEWVAVIWYDGSNKYYAD SVKGRFTISRDNSKNTLYLQMNSLRAEDTAV YYCASIAAAGRDYWGQGTLVTVSS | 633 | QSALTQPPSASGSPGQSVTISCTGTSSDVGG YNYVSWYQQHPGKAPKLMIYEVSKRPSGVPD RFSGSKSGNTASLTVSGLQAEDEADYYCSSY AGSNNLVFGGGTKLTVL |
| 446 | EVQLVESGGGLVQPGGSLRLSCAASGFTFSS YAMSWVRQAPGKGLEWVSAISGSGGSTYYAD SVKGRFTISRDNSKNTLYLQMNSLRAEDTAV YYCAKAPELRFDYWGQGTLVTVSS | 634 | QSALTQPASVSGSPGQSITISCTGTSSDVGG YNYVSWYQQHPGKAPKLMIYEVSNRPSGVSN RFSGSKSGNTASLTISGLQAEDEADYYCSSY TSSSTYVFGTGTKVTVL |
| 447 | QVQLVQSGAEVKKPGASVKVSCKASGYTFTS YGISWVRQAPGQGLEWMGWISPYNGNTNYAQ NLQDRVTMITDTSTTTAYMELRSLRSDDTAV YYCARNHYYYMDVWGKGTTVTVSS | 635 | QSALTQPASVSGSPGQSITISCTGTSSDVGG YNYVSWYQQHPGKAPKLMIYDVSKRPSGVSN RFSGSKSGNTASLTISGLQAEDEADYYCCSY AGSSTYVVFGGGTKLTVL |

TABLE 5-continued

Full Heavy Chain (HC) and Light Chain (LC) Sequences for Anti-EPOR
Antibodies

| SEQ ID NO | Full HC AA sequence | SEQ ID NO | Full LC AA sequence |
|---|---|---|---|
| 448 | QVQLQQWGAGLLKPSETLSLTCAVYGGSFSG YYWSWIRQPPGKGLEWIGEINHSGSTNYNPS LKSRVTISVDTSKNQFSLKLSSVTAADTAVY YCARGELGIGYWYFDLWGRGTLVTVSS | 636 | SSELTQDPAVSVALGQTVRITCQGDSLRSYY ASWYQQKPGQAPVLVIYGKNNRPSGIPDRFS GSSSGNTASLTITGAQAEDEADYYCNSRDSS GNHVVFGGGTKLTVL |
| 449 | QVQLVESGGGVVQPGRSLRLSCAASGFTFSS YGMHWVRQAPGKGLEWVAVIWYDGSNKYYAD SVKGRFTISRDNSKNTLYLQMNSLRAEDTAV YYCARDTGITMVRGVFDYWGQGTLVTVSS | 637 | SYVLTQPPSVSVAPGKTARITCGGNNIGSKS VHWYQQKPGQAPVLVIYYDSDRPSGIPERFS GSNSGNTATLTISRVEAGDEADYYCQVWDSS SDHPVFGGGTKLTVL |
| 450 | EVQLVESGGDLVQPGGSLKLSCAASGFSFSG STLHWVRQASGKGLEWIGHIRSKPNNYATLY GASVKGRFTISRDDSKNTAYLQMNSLKIEDT AVYYCNGVYGGSSYFFDYWGQGTLVTVSS | 638 | QAVLTQPASLSASPGASASLTCTLRSGINVG TYRIYWYQQKPGSPPQYLLRYKSDSDKQQGS GVPSRFSGSKDASANAGILLISGLQSEDEAD YYCMIWHSSAVVFGGGTKLTVL |
| 451 | QVQLVQSGAEVKKPGASVKVSCKASGYTFTG YYMHWVRQAPGQGLEWMGWINPNSGGTNYAQ KFQGRVTMTRDTSISTAYMELSRLRSDDTAV YYCARDETTIFDYWGQGTLVTVSS | 639 | SSELTQDPAVSVALGQTVRITCQGDSLRSYY ASWYQQKPGQAPVLVIYGKNNRPSGIPDRFS GSSSGNTASLTITGAQAEDEADYYCNSRDSS GNWVFGGGTKLTVL |
| 452 | QVQLVQSGAEVTKPGASVKVSCKASGYTFIN YGISWVRQAPGQGLEWMGWISAYSGNRNYAQ KFQDRVIMTTDTFTNTAYMELRSLRSDDTAV YYCARLGCNGTSCYTSWYYHFYMDVWGKGTT VTVSS | 640 | SYELTQPPSVSVSPGQTARITCSGDALPKKY AYWYQQKSGQAPVLVIYEDSKRPSGIPERFS GSSSGTMATLTISGAQVEDEADYYCYSTDSS GNHSWVFGGGTKLTVL |
| 453 | QVQLVESGGGVVQPGRSLRLSCAASGFTFSS YGMHWVRQAPGKGLEWVAVIWYDGSNKYYAD SVKGRFTISRDNSKNTLYLQMNSLRAEDTAV YYCARDEDYYGSGSYSFDYWGQGTLVTVSS | 641 | QSALTQPASVSGSPGQSITISCTGTSSDVGG YNYVSWYQQHPGKAPKLMIYEVSNRPSGVSN RFSGSKSGNTASLTISGLQAEDEADYYCSSY TSSSTLVFGGGTKLTVL |
| 454 | QVQLQESGPGLVKPSGTLSLTCAVSGGSISS SNWWSWVRQPPGKGLEWIGEIYHSGSTNYNP SLKSRVTISVDKSKNQFSLKLSSVTAADTAV YYCARRGAARPFDYWGQGTLVTVSS | 642 | QAVLTQPASLSASPGASASLTCTLRSGINVG TYRIYWYQQKPGSPPQYLLRYKSDSDKQQGS GVPSRESGSKDASANAGILLISGLQSEDEAD YYCMIWHSSAYVVFGGGTKLTVL |
| 455 | QITLKESGPTLVKPTQTLTLTCTFSGFSLST SGVGVGWIRQPPGKALEWLALIYWNDDKRYS PSLKSRLTITKDTSKNQVVLTMTNMDPVDTA TYYCAHSNWNYGYFDLWGRGTLVTVSS | 643 | SYELTQPPSVSVSPGQTASITCSGDKLGDKY ACWYQQKPGQSPVLVIYQDSKRPSGIPERFS GSNSGNTATLTISGTQAMDEADYYCQAWDSS TAWVFGGGTKLTVL |
| 456 | EVQLVESGGGLVQPGGSLRLSCAASGFTFSS YAMSWVRQAPGKGLEWVSAISGSGGSTYYAD SVKGRFTISRDNSKNTLYLQMNSLRAEDTAV YYCAKKDIVATHFDYWGQGTLVTVSS | 644 | SYELTQPPSVSVSPGQTARITCSGDALPKKY AYWYQQKSGQAPVLVIYEDSKRPSGIPERFS GSSSGTMATLTISGAQVEDEADYYCYSTDSS GNHKVFGGGTKLTVL |
| 457 | EVQLVESGGGLVKPGGSLRLSCAASGFTFSN AWMSWVRQAPGKGLEWVGRIKSKTDGGTTDY AAPVKGRFTISRDDSKNTLYLQMNSLKTEDT AVYYCTTADYDFWSGYYMDVWGKGTTVTVSS | 645 | SSEMTQDPAVSVALGQTVRITCQGDSLRSYY ASWYQQKPGQAPVLVIYGKNNRPSGIPDRFS GSSSGNTASLTITGAQAEDEADYYCNSRDSS GNHWVFGGGTKLTVL |
| 458 | EVQLVESGGGLVQPGGSLRLSCAASGFTFSS YSMNWVRQAPGKGLEWVSYISSSSSTIYYAD SVKGRFTISRDNAKNSLYLQMNSLRDEDTAV YYCARDRYNFDYWGQGTLVTVSS | 646 | QSALTQPRSVSGSPGQSVTISCTGTSSDVGG YNYVSWYQQHPGKAPKLMIYDVSKRPSGVPD RFSGSKSGNTASLTISGLQAEDEADYYCCSY AGSSWVFGGGTKLTVL |
| 459 | EVQLVESGGGVVRPGGSLRLSCAASGFTFDD YGMSWVRQAPGKGLEWVSGINWNGGSTGYAD SVKGRFTISRDNAKNSLYLQMNSLRAEDTAL YYCARGGDTAMVTVFDYWGQGTLVTVSS | 647 | QSALTQPASVSGSPGQSITISCTGTSSDVGG YNYVSWYQQHPGKAPKLMIYEVSNRPSGVSN RFSGSKSGNTASLTISGLQAEDEADYYCSSY TSSSTLVFGTGTKVTVL |
| 460 | EVQLVQSGAEVKKPGESLKISCKGSGYSFTS YWIGWVRQMSGKGLEWMGIIYPSDSDTRYSP SFQGQVTISADKSISTAYLQWSSLKASDTAM YYCARQINWGAIDYWGQGTLVTVSS | 648 | QSALTQPASVSGSPGQSITISCTGTSSDVGG YNYVSWYQQHPGKAPKLMIYDVSKRPSGVSN RFSGSKSGNTASLTISGLQAEDEADYYCCSY AGSSTFVVFGGGTKLTVL |
| 461 | QVQLVQSGAEVKKPGASVKVSCKASGYTFTS YGISWVRQAPGQGLEWMGWISVYNGNTNYAQ KLQGRVTMTTDTSTSTAYMELRSLRSDDTAV YYCARQITATRGFDYWGQGTLVTVSS | 649 | QSALTQPASVSGSPGQSITISCTGTSSDVGG YNYVSWYQQHPGKAPKLMIYDVSKRPSGVSN RFSGSKSGNTASLTISGLQAEDEADYYCCSY AGSSTFVVFGGGTKLTVL |

TABLE 5-continued

Full Heavy Chain (HC) and Light Chain (LC) Sequences for Anti-EPOR
Antibodies

| SEQ ID NO | Full HC AA sequence | SEQ ID NO | Full LC AA sequence |
|---|---|---|---|
| 462 | QVQLQQSGPGLVKPSQTLSLTCAISGDSVSS NSAAWSWIRQPSRGLEWLGRTYYRSKWYND YAVSVKSRITINPDTSKNQFSLQLNSVTPED TAVYYCARKWELRDTFDIWGQGTMVTVSS | 650 | QSALTQPASVSGSPGQSITISCTGTSSDVGG YNYVSWYQQHPGKAPKLMIYDVSKRPSGVSN RFSGSKSGNTASLTISGLQAEDEADYYCCSY AGSSTLGIDWVFGGGTKLTVL |
| 463 | QVQLQQWGAGLLKPSETLSLTCAVYGGSFSG YYWSWIRQPPGKGLEWIGEINHSGSTNYNPS LKSRVTISVDTSKNQFSLKLSSVTAADTAVY YCASYGDFFDYWGQGTLVTVSS | 651 | LPVLTQPPSASALLGASIKLTCTLSSEHSTY TIEWYQQRPGRSPQYIMKVKSDGSHSKGDGI PDRFMGSSSGADRYLTFSNLQSDDEAEYHCG ESHTIDGQVGVVFGGGTKLTVL |
| 464 | EVQLVESGGGLVKPGGSLRLSCAASGFTFSS YSMNWVRQAPGKGLEWVSSISSSSSYIYYAD SVKGRFTISRDNAKNSLYLQMNSLRAEDTAV YYCARETELTVMDVWGKGTTVTVSS | 652 | LPVLTQPPSASALLGASIKLTCTLSSEHSTY TIEWYQQRPGRSPQYIMKVKSDGSHSKGDGI PDRFMGSSSGADRYLTFSNLQSDDEAEYHCG ESHTIDGQVGWVFGGGTKLTVL |
| 465 | EVQLVESGGGLVKPGGSLRLSCAASGFTFSN AWMSWVRQAPGKGLEWVGRIKSKTDGGTTDY AAPVKGRFTISRDDSKNTLYLQMNSLKTEDT AVYYCTTDWEYYDFWSGYYSPYFDYWGQGTL VTVSS | 653 | SSELTQDPAVSVALGQTVRITCQGDSLRSYY ASWYQQKPGQAPVLVIYGKNNRPSGIPDRFS GSSSGNTASLTITGAQAEDEADYYCNSRDSS GNHVVFGGGTKLTVL |
| 466 | QVQLQESGPGLVKPSQTLSLTCTVSGGSISS GGYYWSWIRQHPGKGLEWIGYIYYIGITYYN PSLKSRVTISVDTSKNQFSLKLSSVTAADTA VYYCARAFDYWGQGTLVTVSS | 654 | SYVLTQPPSVSVPPGKTARITCGGNNVGSKS VHWYQQKPGQAPVLVIYYDTDRPSGIPERFS GSNSGNTATLSISRVEAGDEADYYCQVWDSR SDHVVFGGGTKLTVL |
| 467 | QVQLQESGPGLVKPSQTLSLTCTVSGGSISS GGYYWSWIRQHPGKGLEWIGYFYYSGSTYYN PSLKSRVSISVDTSKNQFSLRLSSVTVADTA VYYCVRAFDYWGQGTLVTASS | 655 | SYVLTQPPSVSVAPGKTARITCGGNTFGSKT VHWYQQKPGQAPVLVIYDSDRPSGIPERFS GSNSGNTATLTISRVEAGDEADYYCQVWDLY SAHVVFGGGTNLTVL |
| 468 | EVQLVESGGGLVKPGGSLRLSCAASGFTFSN AWMSWVRQAPGKGLEWVGRIKSKTDGGTTDY AAPVKGRFTISRDDSKNTLYLQMNSLKTEDT AVYYCTTGANWGQGTLVTVSS | 656 | SYELTQPPSVSVSPGQTARITCSGDALPKKY AYWYQQKSGQAPVLVIYEDSKRPSGIPERFS GSSSGTMATLTISGAQVEDEADYYCYSTDSS GNHWVFGGGTKLTVL |
| 469 | QVQLVQSGAEVKKPGASVKVSCKASGYTFTS YDINWVRQATGQGLEWMGWMNPNSGNTGYAQ KFQGRVTMTRNTSISTAYMELSSLRSEDTAV YYCARVAFDIWGQGTMVTVSS | 657 | QSALTQPASVSGSPGQSITISCTGTSSDVGG YNYVSWYQQHPGKAPKLMIYEVSNRPSGVSN RFSGSKSGNTASLTISGLQAEDEADYYCSSY TSSSTVFGGGTKLTVL |
| 470 | QVQLVQSGAEAKKPGASVKVSCMASGYTFTT YGISWVRQAPGQGLEWMGWISAYNGNTKYAQ KLQGRVTMTDTSTRTAYMELRSLRSDDTAV YYCARQIGDYWGQGTLVTVSS | 658 | QSALTQPPSASGSPGQSVTISCTGTSSDVGG YNYVSWYQQHPGKAPKLMIYEVIKRPSGVPD RFSGSKSGNTASLTVSGLQAEDEADYYCSAY AGSNNVVFGGGTQLTVL |
| 471 | EVQLVESGGGLVQPGGSLRLSCAASGFTFSS YAMSWVRQAPGKGLEWVSAISGSGGSTYYAD SVKGRFTISRDNSKNTLYLQMNSLRAEDTAV YYCHQTGFDYWGQGTLVTVSS | 659 | QSVLTQPPSASGTPGQRVTISCSGSSSNIGS NTVNWYQQLPGTAPKLLIYSNNQRPSGVPDR FSGSKSGTSASLAISGLQSEDEADYYCAAWD DSLNGWVFGGGTKLTVL |
| 472 | EVQLVESGGGLVKPGGSLRLSCAASGFTFSN AWMSWVRQAPGKGLEWVGRIKSKSDGGTRDY AAPVKGRFTISRDDSKNTLYLQMNSLKTEDT AMFYCTTGGTHWGQGTLVTVSS | 660 | SYELTQPPSVSVSPGQTARITCSADALPKQY AYWYQQKPGQAPVLVIYKDSERPSGIPERFS GSSSGTTVTLTISGVQAEDEADYYCQSADSS ATWVFGGGTKLTVL |
| 473 | QVQLVQSGAEVKKPGASVKVSCKASGYTFTS YDINWVRQATGQGLEWMGWMNPNSGNTGYAQ KFQGRVTMTRNTSISTAYMELSSLRSEDTAV YYCARRSFLDYWGQGTLVTVSS | 661 | SYELTQPPSVSVSPGQTARITCSGDALPKKY AYWYQQKSGQAPVLVIYEDSKRPSGIPERFS GSSSGTMATLTISGAQVEDEADYYCYSTDSS GNHRVFGGGTKLTVL |
| 474 | EVQLVESGGGLVKPGGSLRLSCAASGFTFSN AWMSWVRQAPGKGLEWVGRIKSKTDGGTTDY ATPVKGRFTISRADSKNTLFLQMSSLKTEDT AVYFCTTGGTNWGQGTLVTVSS | 662 | SYELTQPPSVSVSPGQTARITCSADALPKQY AYWYQQKPGQAPVVVIYKDSERPSGIPERFS GSSSGTTVTLTISGVQAEDEADYYCQSLDSS GTYWVFGGGTKLTVL |
| 475 | EVQLVESGGGLVKPGGSLRLSCAASGFTFSS YSMNWVRQAPGKGLEWVSSISSSSSYIYYAD SVKGRFTISRDNAKNSLYLQMNSLRAEDTAV YYCARESSGFDYWGQGTLVTVSS | 663 | SYELTQPPSVSVSPGQTASITCSGDKLGDKY ACWYQQKPGQSPVLVIYQDSKRPSGIPERFS GSNSGNTATLTISGTQAMDEADYYCQAWDSS TVVFGGGTKLTVL |

TABLE 5-continued

Full Heavy Chain (HC) and Light Chain (LC) Sequences for Anti-EPOR
Antibodies

| SEQ ID NO | Full HC AA sequence | SEQ ID NO | Full LC AA sequence |
|---|---|---|---|
| 476 | QVQLVQSGAEVKKPGASVKVSCKASGYTFTS YDINWVRQATGQGLEWMGWMNPNSGNTGYAQ KFQGRVTMTRNTSISTAYMELSSLRSEDTAV YYCARGSSWFDYWGQGTLVTVSS | 664 | SYELTQPPSVSVSPGQTASITCSGDKLGDKY ACWYQQKPGQSPVLVIYQDSKRPSGIPERFS GSNSGNTATLTISGTQAMDEADYYCQAWDSS TVVFGGGTKLTVL |
| 477 | EVQLVESGGGLVKPGGSLRLSCAASGFTFSN AWMSWVRQAPGKGLEWVGRIKSKTDGGTTDY AAPVKGRFTISRDDSKNTLYLQMNSLKTEDT AVYYCTLNWGDYWGQGTLVTVSS | 665 | SYELTQPPSVSVSPGQTASITCSGDKLGDKY ACWYQQKPGQSPVLVIYQDSKRPSGIPERFS GSNSGNTATLTISGTQAMDEADYYCQAWDSS TVVFGGGTKLTVL |
| 478 | EVQLVESGGGLVKPGGSLRLSCAASGFTFSS YSMNWVRQAPGKGLEWVSSISSSSSYIYYAD SVKGRFTISRDNAKNSLYLQMNSLRAEDTAV YYCARAADAFDIWGQGTMVTVSS | 666 | SSELTQDPAVSVALGQTVRITCQGDSLRSYY ASWYQQKPGQAPVLVIYGKNNRPSGIPDRFS GSSSGNTASLTITGAQAEDEADYYCNSRDSS GNHWVFGGGTKLTVL |
| 479 | EVQLVESGGGLVQPGGSLRLSCAASGFTFSS YDMHWVRQATGKGLEWVSAIGTAGDTYYPGS VKGRFTISRENAKNSLYLQMNSLRAGDTAVY YCARGGSDAFDIWGQGTMVTVSS | 667 | QSALTQPASVSGSPGQSITISCTGTSSDVGG YNYVSWYQQHPGKAPKLMIYDVSKRPSGVSN RFSGSKSGNTASLTISGLQAEDEADYYCCSY AGSVVFGGGTKLTVL |
| 480 | EVQLVESGGGLVKPGGSLRLSCTASEFTFRN AWMIWVRQAPGKGLEWVGRIRSEIDGGTTDY AAPVKGRFTISRDDSKDTLYLYMNSLKVEDT AVYYCTTDHPYYWGHGTLVTVSS | 668 | SSELTQDPAVSVALGQTVRITCQGDSLRSYY ASWYQQKPGQAPVLVIYGKNNRPSGIPDRFS GSSSGNTASLTITGAQAEDEADYYCNSRDSS GNHVVFGGGTKLTVL |
| 481 | EVQLVESGGGLVKPGGSLRLSCAASGFTFSN AWMSWVRQAPGKGLEWVGRIKSKTDGGTTDF TAPVKGRFTISRDDSKNTLYLQMNSLKTEDT AVYYCTTDHPYYWGQGTLVTVSS | 669 | SSELTQDPAVSVALGQTVRITCQGDSLRSYY ASWYQQKPGQAPVLVIYGKNNRPSGIPDRFS GSSSGNTASLTITGAQAEDEADYYCNSRDSS GNHWVFGGGTKLTVL |
| 482 | QVQLVESGGGVVQPGRSLRLSCAASGFTFSN YGIHWVRQAPGKGLEWVAVIWYDGSNEYYVD SVKGRFIISRDNSKNTLYLQMNSLRAEDTAL YYCALAVTGFDYWGQGTLVTVSS | 670 | QSVLTQPPSVSEAPRQRVTISCSGSSSNIGN NAVNWYQQLPGKAPKLLIYYDDLLPSGVSDR FSGSKSGTSASLAISGLQSEDEADYYCAAWD DRLNGPVFGGGTKLTVL |
| 483 | QVQLVESGGGLVKPGGSLRLSCAASGFTFSD YYMSWIRQAPGKGLEWVSYISSSGSTIYYPD SVKGRFTISRDNAKNSLYLQMNSLRAEDTAV YYCARDGAAFDIWGQGTMVTVSS | 671 | QSALTQPASVSGSPGQSITISCTGTSSDVGG YNYVSWYQQHPGKAPKLMIYDVSKRPSGVSN RFSGSKSGNTASLTISGLQAEDETDYYCCSY AGSSTLVFGGGTKLTVL |
| 484 | QIQLVQSGAEMKKPGASVKVSCKASGYTFTN YGISWVRQAPGQGLEWMGWINTYNDKTNFAL KVQGRVTMTTDTSTSTAYMELRSLRSDDTAV YYCARDRGYSFDYWGQGTLVTVSS | 672 | SYELTQPPSVSVSPGQTASITCSGDKLGDKH ACWYQQKPGQSPMLVIYQDSKRPSGIPERFS GSNSGNTATLTISGTQPMDEADYYCQAWDSS TFGGGTKLTVL |
| 485 | QVQLVQSGAEVKKPGASVKVSCKASGYTFTS YGISWVRQAPGQGLEWMGWISAYNGNTNYAQ RLQGRVTMTTDTSTSTAYMELRSLISDDTAV YYCARNHYYYLDVWGKGTTVTVSS | 673 | SYELTQPSSVSVSPGQTARITCSGDVLAKKY ARWFQQKPGQAPVLVIYKDSERPSGIPERFS GSSSGTTVTLTISGAQVEDEADYYCYSAADN NRVFGGGTKLTVL |
| 486 | EVQLVESGGGLVQPGGSLRLSCAASGFTFSS YDMHWVRQATGKGLEWVSAIGTAGDTYYPGS VKGRFTISRENAKNSLYLQMNSLRAGDTAVY YCARVSPTGTTDYWGQGTLVTVSS | 674 | SYELTQPSSVSVSPGQTARITCSGDVLAKKY ARWFQQKPGQAPVLVIYKDSERPSGIPERFS GSSSGTTVTLTISGAQVEDEADYYCYSAADN NLVFGGGTKLTVL |
| 487 | EVQLVESGGGLVKPGGSLRLSCAASGFTFSN AWMSWVRQAPGKGLEWVGRIKSKTDGGTTDY AAPVKGRFTISRDDSKNTLYLQMNSLKTEDT AVYYCTARPLGDVWGKGTTVTVSS | 675 | SYELTQPSSVSVSPGQTARITCSGDVLAKKY ARWFQQKPGQAPVLVIYKDSERPSGIPERFS GSSSGTTVTLTISGAQVEDEADYYCYSAADN NYVFGTGTKVTVL |
| 488 | EVQLVESGGGLVKPGGSLRLSCAASGFTFSN AWMSWVRQAPGKGLEWVGRIKSKTDGGTTDY AAPVKGRFTISRDDSKNTLYLQMNSLKTEDT AVYYCTTDNGFDYWGQGTLVTVSS | 676 | SYELTQPSSVSVSPGQTARITCSGDVLAKKY ARWFQQKPGQAPVLVIYKDSERPSGIPERFS GSSSGTTVTLTISGAQVEDEADYYCYSAADN NLVFGGGTKLTVL |
| 489 | EVQLVESGGGLVKPGGSLRLSCAASGFTFSS YSMNWVRQAPGKGLEWVSSISSSSSYIYYAD SVKGRFTISRDNAKNSLYLQMNSLRAEDTAV YYCARDLISSFDYWGQGTLVTVSS | 677 | SSELTQDPAVSVALGQTVRITCQGDRLRSYY ASWYQQKPGQAPVLVIYGKNNRPSGIPDRFS GSSSGNTASLTITGAQAEDEADYHCNSRDSS GNHLVFGGGTKLTVL |
| 490 | EVQLVESGGGLVQPGGSLRLSCAASGFTFSS YWMSWVRQAPGKGLEWVANIKQDGSEKYYVD SVKGRFTISRDNAKNSLYLQMNSLRAEDTAV YYCARRIVGAFDYWGQGTLVTVSS | 678 | SSELTQDPAVSVALGQTVRITCQGDSLRSYY ASWYQQKPGQAPVLVIYGKNNRPSGIPDRFS GSSSGNTASLTITGAQAEDEADYYCNSRDSS GNHLVFGGGTKLTVL |

TABLE 5-continued

Full Heavy Chain (HC) and Light Chain (LC) Sequences for Anti-EPOR
Antibodies

| SEQ ID NO | Full HC AA sequence | SEQ ID NO | Full LC AA sequence |
|---|---|---|---|
| 491 | QVQLIQSGTEVKKPGASVKVSCMASRYTFTS YYIHWVRQAPGQGLEWMGIINPSGGTTGYAQ KFQGRVTMTRDTSTSTVYMELYSLRSEDTAV YYCARGGWGTMDVWGKGTTVTVSS | 679 | SYVLTQPPSVSVAPGKTARITCGGNNIGSKS VHWYQQKPGQAPVLVIYYDSDRPSGIPERFS GSNSGNTATLTISRVEAGDEADYYCQVWDSS SDHVVFGGGTKLTVL |
| 492 | EVQLVESGGGLVQPGGSLRLSCAASGFTFSS YSMNWVRQAPGKGLEWVSYISSSSSTIYYAD SVKGRFTISRDNAKNSLYLQMNSLRDEDTAV YYCAREGWELLDYWGQGTLVTVSS | 680 | SYELTQPPSVSVSPGQTARITCSGDALPKKY AYWYQQKSGQAPVLVIYEDSKRPSGIPERFS GSSSGTMATLTISGAQVEDEADYYCYSTDSS GNHRVFGGGTKLTVL |
| 493 | EVQLVESGGGLIQPGGSLRLSCAASGLTVST NYMSWVRQAPGKGLEWVSVLYSGGGTYYADS VKGRFTISRDNSKNTLCLQMNSLRAEDTAMY YCARDNWDSYFDYWGQGTLVTVSS | 681 | QTVVTQEPSLTVSPGGTVTLTCASSTGAVTS GYYPNWFQQKPGQAPRALIYSTSNKHSWTPA RFSGSLLGGKAALTLSGVQPEDEAEYYCLLY YGGARVFGGGTKLTVL |
| 494 | EVQLVESGGGVVRPGGSLRLSCAASGFTFDD YGMSWVRQAPGKGLEWVSGINWNGGSTGYAD SVKGRFTISRDNAKNSLYLQMNSLRAEDTAL YYCARTTVTHMDVWGKGTTVTVSS | 682 | QSALTQPPSASGSPGQSVTISCTGTSSDVGG YNYVSWYQQHPGKAPKLMIYEVSKRPSGVPD RFSGSKSGNTASLTVSGLQAEDEADYYCSSY AGSNNLVFGGGTKLTVL |
| 495 | EVQLVESGGGLIQPGGSLRLSCAASGFTVSS NYMSWVRQAPGKGLEWVSVIYSGGGTYYADS VKGRFTISRDNSKNTLYLQMNSLRAEDTAVY YCARDWNYDAFDIWGQGTMVTVSS | 683 | QSALTQPASVSGSPGQSITISCTGTSSDVGG YNYVSWYQQHPGKAPKLMIYDVSKRPSGVSN RFSGSKSGNTASLTISGLQAEDEADYYCCSY AGSSTWVFGGGTKLTVL |
| 496 | EVQLVESGGGLVKPGGSLRLSCAASGFTFSS YSMNWVRQAPGKGLEWVSSISSSSSYIYYAD SVKGRFTISRDNAKNSLYLQMNSLRAEDTAV YYCARGDPGWFDPWGQGTLVTVSS | 684 | QSALTQPASVSGSPGQSITISCTGTSSDVGG YNYVSWYQQHPGKAPKLMIYDVSKRPSGVSN RFSGSKSGNTASLTISGLQAEDEADYYCCSY AGSSTFWVFGGGTKLTVL |
| 497 | EVQLVESGGGLVQPGGSLRLSCAASGFTFSS YWMHWVRQAPGKGLVWVSRINSDGSSTSYAD SVKGRFTISRDNAKNTLYLQMNSLRAEDTAV YYCARENWNYWFDPWGQGTLVTVSS | 685 | SYELTQPPSVSVSPGQTASITCSGDKLGDKY ACWYQQKPGQSPVLVIYQDSKRPSGIPERFS GSNSGNTATLTISGTQAMDEADYYCQAWDSS TVVFGGGTKLTVL |
| 498 | QVQLQESGPGLVKPSGTLSLTCAVSGGSISS NNWWSWVRQPPGKGLEWIGEIYHSGSTNYNP SLKSRVTISVDKSKNQFSLKVNSVTAADTAI FYCARLRPGDSFDYWGLGTLVTVSS | 686 | SYELTQPPSVSVSPGQTASITCSGDKLGDKY ACWYQQRPGQSPVLVIYQDNKRPSGIPERFS GSNSGNTATLTISGTQAMDEADYYCQAWDSS TALVFGGGTKLTVL |
| 499 | QVHLVQSGSELKKPGASVKVSCKASGYTFTR NGLNWVRQAPGQGLEWMGWINTNIGNPTYAQ GFTGRFVFSLDTSVSTAYLQISRLQAEDTAV YYCARSPNWGLFDYWGQGTLVTVSS | 687 | SYELTQPPSVSVSPGQTASITCSGDKLGDKY ACWYQQKPGQSPVLVIYQDSKRPSGIPERFS GSNSGNTATLTISGTQAMDEADYYCQAWDSS TSGVFGGGTKLTVL |
| 500 | EVQLVESGGGLVKPGGSLRLSCAASGFTFSS YSMNWVRQAPGKGLEWVSSISSSSSYIYYAD SVKGRFTISRDNAKNSLYLQMNSLRAEDTAV YYCARDRGATGFDYWGQGTLVTVSS | 688 | SSELTQDPAVSVALGQTVRITCQGDSLRSYY ASWYQQKPGQAPVLVIYGKNNRPSGIPDRFS GSSSGNTASLTITGAQAEDEADYYCNSRDSS GNHWVFGGGTKLTVL |
| 501 | QVQLVQSGAEVKKPGASVKVSCKASGYTFTS YGISWVRQAPGQGLEWMGWISAYNGNTNYAQ KLQGRVTMTTDTSTSTAYMELRSLRSDDTAV YYCARESGELLGDWGQGTLVTVSS | 689 | SYELTQPPSVSVSPGQTARITCSGDALPKKY AYWYQQKSGQAPVLVIYEDSKRPSGIPERFS GSSSGTMATLTISGAQVEDEADYYCYSTDSS GNHRVFGGGTKLTVL |
| 502 | EVQLVESGGGLVQPGGSLRLSCAASGFTFSS YDMHWVRQATGKGLEWVSAIGTAGDTYYPGS VKGRFTISRENAKNSLYLQMNSLRAGDTAVY YCARYSGSYYYFDYWGQGTLVTVSS | 690 | SSELTQDPAVSVALGQTVRITCQGDSLRSYY ASWYQQKPGQAPVLVIYGKNNRPSGIPDRFS GSSSGNTASLTITGAQAEDEADYYCNSRDSS GNHVVFGGGTKLTVL |
| 503 | QVQLVESGGGVVQPGRSLRLSCAASGFTFSS YGMHWVRQAPGKGLEWVAVIWYDGSNKYYAD SVKGRFTISRDNSKNTLYLQMNSLRAEDTAV YYCARGIAAAGKDYWGQGTLVTVSS | 691 | SYELTQPPSVSVSPGQTARITCSGDALPKKY AYWYQQKSGQAPVLVIYEDSKRPSGIPERFS GSSSGTMATLTISGAQVEDEADYYCYSTDSS GNHAVFGGGTQLTVL |
| 504 | EVQLVQSGAEVKKPGESLKISCKGSGYSFTS YWIGWVRQMPGKGLEWMGIIYPGDSDTRYSP SFQGQVTISADKSISTAYLQWSSLKASDTAM YYCARQDSNYVFDYWGQGTLVTVSS | 692 | SYVLTQPPSVSVAPGKTARITCGGNNIGSKS VHWYQQKPGQAPVLVIYYDSDRPSGIPERFS GSNSGNTATLTISRVEAGDEADYYCQVWDSS SDHVVFGGGTKLTVL |

TABLE 5-continued

Full Heavy Chain (HC) and Light Chain (LC) Sequences for Anti-EPOR
Antibodies

| SEQ ID NO | Full HC AA sequence | SEQ ID NO | Full LC AA sequence |
|---|---|---|---|
| 505 | EVQLVESGGGLVQPGGSLRLSCAASGFTFSN YWMSWVRQAPGKGLEWVANIKYDGREQYYVD SVKGRFAISRDNAKNSLSLQMNSLRAEDTAI YYCARDHSAWSFDYWGQGTLVTVSS | 693 | QSVLTQSPSAFGTPGQRVTISCSGSISNLGS NTVNWYQQLPGTAPKLLIYSNNQRPSGVPDR FSGSKSGTSASLAISGLQFEDEADYHCATWD DSLNGRVFGGGTKLTVL |
| 506 | EVQLVESGGGLVQPGGSLRLSCAASGFTFSS YWMSWVRQAPGKGLEWVANIKQDGSEKYYVD SVKGRFTISRDNAKNSLYLQMNSLRAEDTAV YYCARRRGSCSFDYWGQGTLVTVSS | 694 | QSALTQPPSASGSPGQSVTISCTGTSSDVGG YNYVSWYQQHPGKAPKLMIYEVSKRPSGVPD RFSGSKSGNTASLTVSGLQAEDEADYYCSSY AGSNNLVFGGGTKLTVL |
| 507 | QVQLVQSGAEVKKPGASVKVSCKASGYTFTS YGISWVRQAPGQGLEWMGWISAYNGNTNYAQ KLQGRVTMTTDTSTSTAYMELRSLRSDDTAV YYCARRSYANCFDYWGQGTLVTVSS | 695 | QSALTQPPSASGSPGQSVTISCTGTSSDVGG YNYVSWYQQHPGKAPKLMIYEVSKRPSGVPD RFSGSKSGNTASLTVSGLQAEDEADYYCSSY AGSNNWVFGGGTKLTVL |
| 508 | EVQLVESGGGLVQPGGSLRLSCAASGFTFSS YWMHWVRQAPGKGLVWVSRINSDGSSTSYAD SVKGRFTISRDNAKNTLYLQMNSLRAEDTAV YYCARDEQLVPFDIWGQGTMVTVSS | 696 | QSALTQPASVSGSPGQSITISCTGTSSDVGG YNYVSWYQQHPGKAPKLMIYDVSKRPSGVSN RFSGSKSGNTASLTISGLQAEDEADYYCCSY AGSSTLVFGGGTKLTVL |
| 509 | EVQLVESGGGLIQPGGSLRLSCAASGFTVSS NYMSWVRQAPGKGLEWVSVIYSGGSTYYADS VKGRFTISRDNSKNTLYLQMNSLRAEDTAVY YCARDGAAAGDFQHWGQGTLVTVSS | 697 | QSALTQPASVSGSPGQSITISCTGTSSDVGG YNYVSWYQQHPGKAPKLMIYDVSKRPSGVSN RFSGSKSGNTASLTISGLQAEDEADYYCCSY AGSSTWVFGGGTKLTVL |
| 510 | EVQLVESGGGLVQPGRSLRLSCAASGFTFDD YAMHWVRQAPGKGLEWVSGISWNSGSIGYAD SVKGRFTISRDNAKNSLYLQMNSLRAEDTAL YYCAKDSGSYYFDYWGQGTLVTVSS | 698 | QSALTQPPSASGSPGQSVTISCTGTSSDVGG YNYVSWYQQHPGKAPKLMIYEVSKRPSGVPD RFSGSKSGNTASLTVSGLQAEDEADYYCSSY AGSNNFVVFGGGTKLTVL |
| 511 | QVQLVESGGGLVKPGGSLRLSCAASGFTFSD YYMSWIRQAPGKGLEWVSYISSSGSTIYYAD SVKGRFTISRDNAKNSLYLQMNSLRAEDTAV YYCARDGQLWSFDYWGQGTLVTVSS | 699 | QSVLTQPPSVSGAPGQRVTISCTGSSSNIGA GYDVHWYQQLPGTAPKLLIYGNSNRPSGVPD RFSGSKSGTSASLAITGLQAEDEADYYCQSY DSSLSDVVFGGGTKLTVL |
| 512 | EVQLVESGGGLIQPGGSLRLSCAASGFTVSR NYMSWVRQAPGKGLEWVSIIYAGGNTYYADS VKGRFTISRDNSKNTLYLQMNSLRAEDTGVY YCGRVVPIGNWFDPWGQGTLVTVSS | 700 | QSVLTQPPSVSGAPGQRVTISCTGSSSNIGA GYDVHWYQQLPGTAPKLLIYGNNNRPSGVPD RFSGSKSGTSASLAITGLQAEDEADYYCQSY DSSLSGWVFGGGTKLTVL |
| 513 | EVQLVESGGGLVQPGGSLRLSCAASGFTFSS YWMSWVRQAPGKGLEWVANIKQDGSEKYYVD SVKGRFTISRDNAKNSLYLQMNSLRAEDTAV YYCARDSNWGVFDYWGQGTLVTVSS | 701 | QAVLTQPASLSASPGASASLTCTLRSGINVG TYRIYWYQQKPGSPPQYLLRYKSDSDKQQGS GVPSRFSGSKDASANAGILLISGLQSEDEAD YYCMIWHSSAWVFGGGTKLTVL |
| 514 | EVQLVESGGGLVQPGGSLRLSCAASGFTFSS YWMSWVRQAPGKGLEWVANIKQDGSEKYYVD SVKGRFTISRDNAKNSLYLQMNSLRAEDTAV YYCARDRLTGDLDYWGQGTLVTVSS | 702 | QAVLTQPASLSASPGASASLTCTLRSGINVG TYRIYWYQQKPGSPPQYLLRYKSDSDKQQGS GVPSRFSGSKDASANAGILLISGLQSEDEAD YYCMIWHSSAWVFGGGTKLTVL |
| 515 | EVYLVESGGGLVQPGGSLRLSCEASGFTFSR YWMHWVRQVPGKGLVWVSRINIVGSTIDYAD SVKGRFTISRDNAKNTLYLQMDSLTAEDTAV YYCAREGDRSDAFAIWGQGTMVTVSS | 703 | SHELTQPLSVSVALGQSAMITCRGNNIGSQN VHWYHQKPGQAPVLVIYRNINRPSGIPERFS GSTSGTTATLTISRAQAGDEADYYCQVWDSS GSWVFGGGAKLTVL |
| 516 | EVQLVESGGGLVKPGGSLRLSCAASGFTFSS YSMNWVRQAPGKGLEWVSSISSSSSYIYYAD SVKGRFTISRDNAKNSLYLQMNSLRAEDTAV YYCARQQWLGYYFDYWGQGTLVTVSS | 704 | SYELTQPPSVSVSPGQTARITCSGDALPKKY AYWYQQKSGQAPVLVIYEDSKRPSGIPERFS GSSSGTMATLTISGAQVEDEADYYCYSTDSS GNHRVFGGGTKLTVL |
| 517 | EVQLVESGGGLVQPGGSLRLSCAASGFTFSI YWMSWVRQAPGKGLEWVATIKEDGSEKYYVD SVKGRFTISRDNAKNSLFLQMNSLRADDTAV YYCARDSNFLYYFDYWGQGDLVTVSS | 705 | SSELTQDPALSVALGQTVRITCQGDSLRSFY ASWYQQKPGQAPVLVIYGKSNRPSGIPDRFS GSGSGNTASLTITGAQAEDEADFYCNSRDTS GNYLVFGGGTKLTVL |
| 518 | QVQLVQSGAEVKKPGASVKVSCKASGYTFTS YGISWVRQAPGQGLEWMGWISAYNGNTNYAQ KLQGRVTMTTDTSTNTAYMELRSLRSDDTAV YYCARQITGTRGFDYWGQGTLVTVSS | 706 | SSELTQDPAVSVALGQTVRITCQGDSLRSYY ASWYQQKPGQAPVLVIYGKNNRPSGIPDRFS GSSSGNTASLTITGAQAEDEADYYCNSRDSS GNHWVFGGGTKLTVL |
| 519 | QVQLVQSGAEVKKPGASVKVSCKASGYTFTS YDINWVRQATGQGLEWMGWMNPNSGNTGYAQ KFQGRVTMTRNTSISTAYMELSSLRSEDTAV YYCARMGYSNYPFDYWGQGTLVTVSS | 707 | SYELTQPPSVSVSPGQTARITCSGDALPKKY AYWYQQKSGQAPVLVIYEDSKRPSGIPERFS GSSSGTMATLTISGAQVEDEADYYCYSTDSS GNHVVFGGGTKLTVL |

TABLE 5-continued

Full Heavy Chain (HC) and Light Chain (LC) Sequences for Anti-EPOR
Antibodies

| SEQ ID NO | Full HC AA sequence | SEQ ID NO | Full LC AA sequence |
|---|---|---|---|
| 520 | QVQLVQSGSEVKKPGASVKVSCKASGYTFTS YYMHWVRQAPGQGLEWMGIINPSGGSTSYAQ KFQGRVTMTRDTSTSTVYMELSSLRSEDTAV YYCARGIPTTVTPDYWGQGTLVTVSS | 708 | SSELTQDPAVSVALGQTVRITCQGDSLRSYY ASWYQQKPGQAPVLVIYGKNNRPSGIPDRFS GSSSGNTASLTITGAQAEDEADYYCNSRDSS GNHLVFGGGTKLTVL |
| 521 | EVQLVESGGGLVQPGGSLRLSCAASGFTFSS YDMHWVRQATGKGLEWVSAIGTAGDTYYPGS VKGRFTISRENAKNSLYLQMNSLRAGDTAVY YCARAGLLTGDAFDIWGQGTMVTVSS | 709 | SYELTQPPSVSVSPGQTARITCSGDALPKKY AYWYQQKSGQAPVLVIYEDSKRPSGIPERFS GSSSGTMATLTISGAQVEDEADYYCYSTDSS GNHRVFGGGTKLTVL |
| 522 | EVQLVESGGGLVKPGGSLRLSCAASGFTFSN AWMSWVRQAPGKGLEWVGRIKSKTDGGTTDY AAPVKGRFTISRDDSKNTLYLQMNSLKTEDT AVYYCITGTTFPFDYWGQGTLVTVSS | 710 | QTVVTQEPSLTVSPGGTVTLTCASSTGAVTS GYYPNWFQQKPGQTPRALIYSTSNKHSWTPA RFSGSLLGGKAALTLSGVQPEDEAEYYCLLY YGGAWVFGGGTKLTVL |
| 523 | EVQLVESGEGLVQPGGSLRLSCAASGFTFSS HAMHWVRQAPGKGLEYVSAISSNGGNTYYAD SVKGRFTISRDNSKNTLYLQVGSLRPEDMAI YYCTKGGVGASFDYWGQGTLVTVSS | 711 | QSALTQPASVSGSPGQSITISCTGTSSDVGG YNYVSWYQHHPGKAPKLMIYEVSNRPSGVSN RFSGSKSGNTASLTISGLQAEDEADYYCSSY TSSSTWVFGGGTKLTVL |
| 524 | EVQLVESGGGLVKPGGSLRLSCAASGFTFSS YSMNWVRQAPGKGLEWVSSISSSSSYIYYAD SVKGRFTISRDNAKNSLYLQMNSLRAEDTAV YYCARGDYSNYYFDYWGQGTLVTVSS | 712 | QSVLTQPPSASGTPGQRVTISCSGSSSNIGS NTVNWYQQLPGTAPKLLIYSNNQRPSGVPDR FSGSKSGTSASLAISGLQSEDEADYYCAAWD DSLNGWVFGGGTKLTVL |
| 525 | QVQLQQWGAGLLKPSETLSLTCAVYGGSFSG YYWSWIRQPPGKGLEWIGEINHSGSTNYNPS LKSRVTISVDTSKNQFSLKLSSVTAADTAVY YCARWEQPWGQGTLVTVSS | 713 | QSALTQPPSASGSPGQSVTISCTGTSSDVGG YNYVSWYQQHPGKAPKLMIYEVSKRPSGVPD RFSGSKSGNTASLTVSGLQAEDEADYYCSSY AGSNNWVFGGGTKLTVL |
| 526 | QVQLVQSGAEVKKPGASVKVSCKASGYTFTS YYMHWVRQAPGQGLEWMGIINPSGGSTSYAQ KFQGRVTMTRDTSTSTVYMELSSLRSEDTAV YYCARRTGTTHYFDYWGQGTLVTVSS | 714 | QSALTQPASVSGSPGQSITISCTGTSSDVGG YNYVSWYQQHPGKAPKLMIYDVSKRPSGVSN RFSGSKSGNTASLTISGLQAEDEADYYCCSY AGSSTLVFGGGTKLTVL |
| 527 | QVQLVESGGGLVKPGGSLRLSCAASGFTFSD YYMSWIRQAPGKGLEWVSYISSSGSTIYYAD SVKGRFTISRDNAKNSLYLQMNSLRAEDTAV YYCARGLWLGLYFDYWGQGTLVTVSS | 715 | QSALTQPASVSGSPGQSITISCTGTSSDVGG YNYVSWYQQHPGKAPKLMIYDVSKRPSGVSN RFSGSKSGNTASLTISGLQAEDEADYYCCSY AGSSTWVFGGGTKLTVL |
| 528 | EVQLVQSGAEVKKPGESLKISCKGSGYSFTS YWIGWVRQMPGKGLEWMGIIYPGDSDTRYSP SFQGQVTISADKSISTAYLQWSSLKASDTAM YYCARFLGSSYYFDYWGQGTLVTVSS | 716 | QSALTQPPSASGSPGQSVTISCTGTSSDVGG YNYVSWYQQHPGKAPKLMIYEVSKRPSGVPD RFSGSKSGNTASLTVSGLQAEDEADYYCSSY AGSNNFEVFGGGTKLTVL |
| 529 | EVQLVESGGGLVQPGGSLRLSCAASGFTFSS YSMNWVRQAPGKGLEWVSYISSSSSTIYYAD SVKGRFTISRDNAKNSLYLQMNSLRDEDTAV YYCARGGBAAAGAFDIWGQGTMVTVSS | 717 | QAVLTQPASLSASPGASASLTCTLRSGINVG TYRIYWYQQKPGSPPQYLLRYKSDSDKQQGS GVPSRFSGSKDASANAGILLISGLQSEDEAD YYCMIWHSSAWVFGGGTKLTVL |
| 530 | QVQLQESGPGLVKPSQTLSLTCTVSGGSISS GGYYWSWIRQHPGKGLEWIGYIFYSGSTYYN PSLKSRVTISVDTSKKQYSLKLRSVTAADTA VYYCARAEWELLWEDPWGQGTLVTVSS | 718 | SYELTQPPSVSVSPGQTASITCSGDKLGDKY ACWYQQKPGQSPVVVIYQDSKRPSGIPERFS GSNSGNTATLTISGTQAMDEADYYCQAWDSS TVVFGGGTKLTVL |
| 531 | QITLKESGPTLVKPTQTLTLTCTFSGFSLST SGVGVGWIRQPPGKALEWLALIYWNDDKRYS PSLKSRLTITKDTSKNQVVLTMTNMDPVDTA TYFCAHNYFYISGYFWGQGTLVTVSS | 719 | SYELTHPPSVSVSPGQTARITCSADALPKQY AYWYQQKPGQAPVLVIYKDSERPSGIPERFS GSSSGTSVTLTISGVQAEDEADYYCQSANSG TWVFGGGTKLTVL |
| 532 | QVQLVESGGGVVQPGRSLRLSCAASGFTFSS YGMHWVRQAPGKGLEWVAVISYDGSNKYYAD SVKGRFTISRDNSKNTLYLQMNSLRAEDTAV YYCAKDPLRVVNYMDVWGKGTTVTVSS | 720 | SYELTQPPSVSVSPGQTASITCSGDKLGDKY ACWYQQKPGQSPVLVIYQDTKRPSGIPERFS GSNSGNTATLTISGTQAMDEADYYCQAWDSS TVVFGGGTKLTVL |
| 533 | QITLKESGPTLVKPTQTLTLTCTESGFSLST SGVGVGWIRQPPGKALEWLALIYWSDDKRYS PSLKNRLTITKDTSKNQVVLTMTNMDPLATA TYYCAQTGYNSWSFDYWGQGTLVTVSS | 721 | SYELTQPPSVSVSPGQTARITCSADALPNQY AYWYQQKPGQAPVLVIYKDSERPSGIPERFS GSSSGTTVTLTISGVQAEDEADYYCQSADSS GTWVFGGGTKLTVL |

TABLE 5-continued

Full Heavy Chain (HC) and Light Chain (LC) Sequences for Anti-EPOR
Antibodies

| SEQ ID NO | Full HC AA sequence | SEQ ID NO | Full LC AA sequence |
|---|---|---|---|
| 534 | QVQLVQSGAEVKKPGASVKVSCKASGYPFTS YGINWVRQAPGQGLEWMGWISAYNSNTNYAE KFQGRVTMTTDTSTTTAYMDLRSLRSDDTAV YYCAREDAWNYGWFDPWGQGTLVTVSS | 722 | SSELTQDPAVSVALGQTVRITCQGDSLRSYY ASWYQQKPGQAPVLVIYGKNNRPSGIPDRFS GSSSGNTASLTITGAQAEDEADYYCNSRDSS GNHVVFGGGTKLTVL |
| 535 | QVQLVQSGAEVKKPGASVKVSCKASGYSFTG YDISWVRQAPRQGLEWMGWISAYNGNTNYAQ KFQARVTMTTDTSTSTAYMELRSLRSDDTAV YYCAREILWLGGYFDYWGQGTLVTVSS | 723 | SYELTQPPSVSVSPGQTARITCSGDALPKKY AYWYQQKSGQAPVLVIYEDSKRPSGIPERFS GSSSGTMATLTISGAQVEDEADYYCYSTDSS GNHRVFGGGTKLTVL |
| 536 | QVHLVQSGSELKKPGASVKVSCKASGYTFSS YDMNWIRQAPGQGLEWMGWINTNTGNPTYAQ GFTGRFVFSLDTSVSTAYLQISSLKAEDTAV YYCAREYSSGWYYFDYWGQGALVTVSS | 724 | SSELTQDPAVSVALGQTVRITCQGDSLRSYY ASWYQQKPGQAPVLVIYGKNNRPSGIPDRFS GSSSGNTASLTITGAQAEDEADYYCNSRDSS GNHLVFGGGTKLTVL |
| 537 | QVQLVQSGAEVKKPGASVKVSCKASGYTFTG YYMHWVRQAPGQGLEWMGWINPNSGGTNYAQ KFQGRVTMTRDTSISTAYMELSRLRSDDTAV YYCARERIAVAPPFDYWGQGTLVTVSS | 725 | SYELTQPPSVSVSPGQTARITCSGDALPKKY AYWYQQKSGQAPVLVIYEDSKRPSGIPERFS GSSSGTMATLTISGAQVEDEADYYCYSTDSS GNHRVFGGGTKLTVL |
| 538 | QVQLVQSGAEVKKPGASVKVSCKASGYTFTS YDINWVRQATGQGLEWMGWMNPNSGNTGYAQ KFQGRVTMTRNTSISTAYMELSSLRSEDTAV YYCARAGWELPEYFQHWGQGTLVTVSS | 726 | SYELTQPPSVSVSPGQTARITCSGDALPKKY AYWYQQKSGQAPVLVIYEDSKRPSGIPERFS GSSSGTMATLTISGAQVEDEADYYCYSTDSS GNHRVFGGGTKLTVL |
| 539 | QVQLVQSGAEVKKPGASVKVSCKASGYTFTS YDINWVRQATGQGLEWMGWMNPNSGNTGYAQ KFQGRVTMTRNTSISTAYMELSSLRSEDTAV YYCARGGDDYSNLFDYWGQGTLVTVSS | 727 | SYELTQPPSVSVSPGQTARITCSGDALPKKY AYWYQQKSGQAPVLVIYEDSKRPSGIPERFS GSSSGTMATLTISGAQVEDEADYYCYSTDSS GNHRVFGGGTKLTVL |
| 540 | QVQLVQSGAEVKKPGSSVKVPCKASGDTFSN FAINWVRQAPGQGLEWMGGIIPIFATANYAQ NFQGRVTITADESTSAAYMEVSSLRFEDTAV YYCARTPLGIGRSFDLWGQGTMVTVSS | 728 | SYVLTQPPSVSVAPGKTARITCGGNNIGSKS VHWYQQTPGQAPVLVIYYDSDRPSGIPDRFS GSNSGNTATLTISRVEAGDEADYYCQVWDSN SDHWVFGGGTKLTVL |
| 541 | EVHLVESGGGLVKPGGSLRLSCAASGFTFSN AWMSWVRQAPGKGLEWVGRIKRKTDGGTTDF ASPVKGRFTISRDDSNNTLYLQMNSLKTEDT AVYYCTTASTVTTGDYWGQGTLVTVSS | 729 | SYELTQPPSVSVSPGQTARITCSADALPKQY AYWYQQKPGQAPVLVIYKDSERPSGIPERFS GSSSGTTVTLTISGVQAEDEADYYCQSADSS GTYPVFGGGTKLTVL |
| 542 | QVQLQQSGPGLVKPSQTLSLTCAISGDSVSS NSAAWNWIRQSPSRGLEWLGRTYYRSKWYND YAVSVKSRITINPDTSKNQFSLQLNSVTPED TAVYYCARERTEIDYWGQGTLVTVSS | 730 | SSELTQDPAVSVALGQTVRITCQGDSLRSYY ASWYQQKPGQAPVLVIYGKNNRPSGIPDRFS GSSSGNTASLTITGAQAEDEADYYCNSRDSS GNHWVFGGGTKLTVL |
| 543 | EVQLVESGGGLVKPGGSLRLSCAASGFTFNN AWMIWVRQAPGKGLEWVGRIKSKTDGGTTDY GAPVKGRFTISRDDSKNTLYLQMNSLKTEDT AVYYCTTGRYFDWFDYWGQGTLVIVSS | 731 | QAVVTQEPSLTVSPGGTVTLTCGSSTGAVTS GHYPYWFQQKPGQAPRTLIYDTSNKHSWTPA RFSGSLLGGKAALTLSGAQPEDEAEYYCLLS YSGARVFGGGTKLTVL |
| 544 | EVQLVESGGGLVKPGGSLRLSCAASGFTFSN AWMSWVRQAPGKGLEWVGRIKSKTDGGTTDY AAPVKGRFTISRDDSKNTLYLQMNSLKTEDT AVYYCTTASGSYWFDPWGQGTLVTVSS | 732 | QSALTQPPSASGSPGQSVTISCTGTSSDVGG YNYVSWYQQHPGKAPKLMIYEVSKRPSGVPD RFSGSKSGNTASLTVSGLQAEDEADYYCSSY AGSNNLVFGGGTKLTVL |
| 545 | QVQLVESGGGVVQPGRSLRLSCAASGFTFSS YGMHWVRQAPGKGLEWVAVISYDGSNKYYAD SVKGRFTISRDNSKNTLYLQMNSLRAEDTAV YYCAKGNWNYGDAFDIWGQGTMVTVSS | 733 | QSALTQPASVSGSPGQSITISCTGTSSDVGG YNYVSWYQQHPGKAPKLMIYDVSKRPSGVSN RFSGSKSGNTASLTISGLQAEDEADYYCCSY AGSSTYVFGTGTKVTVL |
| 546 | QVQLVESGGGVVRPGGSLRLSCAASGFTFDD YGMSWVRQAPGKGLEWVSGINWNGGSTGYAD SVKGRFTISRDNAKNSLYLQMNSLRAEDTAL YYCARENYDFWSGFDPWGQGTLVTVSS | 734 | QSALTQPASVSGSPGQSITISCTGTSSDVGG YNYVSWYQQHPGKAPKLMIYEVSNRPSGVSN RFSGSKSGNTASLTISGLQAEDEADYYCSSY TSSSTVVFGGGTKLTVL |
| 547 | QVHLQQSGPGLVKPSQTLSLTCAISGDSVSS NSAAWNWIRQSPSRGLEWLGRTYYRSKWYNG YAESVKSRITINPDTSKNQFSLQLNSVTPED TAVYYCAREDRGFDYWGQGTLVTVSS | 735 | QSALTQPASVSGSPGQSITISCTGTSSDVGG YNYVSWYQQHPGKAPKLMIYDVSKRPSGVSN RFSGSKSGNTASLTISGLQAEDEADYYCCSY AGSSNVVFGGGTNLTVL |
| 548 | EVQLVESGGGLVQPGRSLRLSCAASGFTFDD YAMHWVRQAPGKGLEWVSGISWNSGSIGYAD SVKGRFTISRDNAKNSLYLQMNSLRAEDTAL YYCAKRAVVTDYYMDVWGKGTTVTVSS | 736 | QSALTQPASVSGSPGQSITISCTGTSSDVGG YNYVSWYQQHPGKAPKLMIYDVSKRPSGVSN RFSGSKSGNTASLTISGLQAEDEADYYCCSY AGSSTFWVFGGGTKLTVL |

TABLE 5-continued

Full Heavy Chain (HC) and Light Chain (LC) Sequences for Anti-EPOR
Antibodies

| SEQ ID NO | Full HC AA sequence | SEQ ID NO | Full LC AA sequence |
|---|---|---|---|
| 549 | EVQLVESGGGLVQPGGSLRLSCAASGFTFSS YSMNWVRQAPGKGLEWVSYISSSSNTIYYAD SVKGRFTISRDNAKNSLYLQMSSLRDEDTAV YYCARTSSWSYDAFDIWGQGTMVTVSS | 737 | QSALTQPPSASGSPGQSVTISCTGTSSDVGG YNYVSWYQQHPGKAPKLMIYEVSKRPSGVPD RFSGSKSGNTASLTVSGLQAEDEADYYCSSY AGSNNFVVFGGGTKLTVL |
| 550 | QVQLVQSGAEVKKPGASVKVSCKASGYTFTS YYMHWVRQAPGQGLEWMGIINPSGGSTSYAQ KFQGRVTMTRDTSTSTVYMELSSLRSEDTAV YYCARERGHTVTPYFDYWGQGTLVTVSS | 738 | SYELTQPPSVSVSPGQTASITCSGDKLGDKY ACWYQQKPGQSPVLVIYQDSKRPSGIPERFS GSNSGNTATLTISGTQAMDEADYYCQATEVE GGGTKLTVL |
| 551 | EVQLVESGGGLVQPGGSLRLSCAASGFNFSS YNMNWVRQTPGKGLEWVSYISNTGNTIYYVD SVKGRFTISRDNAKNSLYLQLNSLRDEDTAV YFCARDGPQVGATDFDYWGQGTLVTVSS | 739 | SYELTQPSSVSVSPGQTAKITCSGDVLAKKY ARWFQQKPGQVPVLVIYKDSERPSGIPERFS GSSSGATVTLTISGAQVEDEADYYCYSAADN KVFGGGTKLTVL |
| 552 | EVQLVESGGGLVKPGGSLRLSCAASGFTFSN AWMSWVRQAPGKGLEWVGRIKRKTDGGTTDY AAPVKGRFTISRDDSKNTLYLQMNSLKTEDT AVYYCTTEYSSSENFDYWGQGTLVTVSS | 740 | SYELTQPPSVSVSPGQTASITCSGDKLGDKY ACWYQQKPGQSPVVVIYQDSKRPSGIPERFS GSNSGNTATLTISGTQAMDEADYYCQAWDSS TAVFGGGTKLTVL |
| 553 | EVQLVESGGGLVQPGGSLRLSCAASGFTFSS YWMHWVRQAPGKGLVWVSRINSDGSSTSYAD SVKGRFTISRDNAKNTLYLQMNSLRAEDTAV YYCARDLGAARPRGFDYWGQGTLVTVSS | 741 | SYELTQPPSVSVSPGQTASITCSGDKLGDKY ACWYQQKPGQSPVLVIYQDSKRPSGIPERFS GSNSGNTATLTISGTQAMDEADYYCQAWDSS TVVFGGGTKLTVL |
| 554 | EVQLVESGGGLVQPGGSLRLSCAASGFTFSS YAMSWVRQAPGKGLEWVSAISGSGGSTYYAD SVKGRFTISRDNSKNTLYLQMNSLRAEDTAV YYCAKEGDSGYDSAFDIWGQGTMVTVSS | 742 | SYELTQPPSVSVSPGQTARITCSGDALPKKY AYWYQQKSGQAPVLVIYEDSKRPSGIPERFS GSSSGTMATLTISGAQVEDEADYYCYSTDSS GNRVFGGGTKLTVL |
| 555 | QVQLQESGPGLVKPSGTLSLTCAVSGGSISS NNWWSWVRQPPGKGLEWIGEIYHSGSTNYNP SLKSRVTISVDKSKNQFSLKLSSVTAADTAV YYCARVLNWNYGDAFDIWGQGTMVTVSS | 743 | SYELTQPPSVSVSPGQTARITCSGDALPKKY AYWYQQKSGQAPVLVIYEDSKRPSGIPERFS GSSSGTMATLTISGAQVEDEADYYCYSTDSS GNHRGFGGGTKLTVL |
| 556 | QVQLQESGPGLVKPSGTLSLTCAVSGGSISS SNWWSWVRQPPGKGLEWIGEIYHSGSTNYNP SLKSRVTISVDKSKNQFSLKLSSVTAADTAV YYCARDPSIVGATAFDIWGQGTMVTVSS | 744 | QSALTQPRSVSGSPGQSVTISCTGTSSDVGG YNYVSWYQQHPGKAPKLMIYDVSKRPSGVPD RFSGSKSGNTASLTISGLQAEDEADYYCCSY AQGVVFGGGTKLTVL |
| 557 | QVQLQESGPGLVKPSGTLSLTCAVSGGSIIS SNWWSWVRQSPGKGLGWIGEIYHSGSTTYNP SLKSRVTISVDKSKNQFSLKLSSVTAADTAL YYCARSHIVGVNGGFDYWGQGTLVTVSS | 745 | SSELTQDPAVSVALGQTVRITCQGDSLRSYY ASWYQQKPGQAPVLLIYGKNNRPSGIPDRFS GSSSGNTASLTITGAQAEDEADYYCNSRDSS GNHWVFGGGTKLTVL |
| 558 | EVQLVESGGGLVKPGGSLRLSCAASGFTFSS YSMNWVRQAPGKGLEWVSSISSSSSYIYYAD SVKGRFTISRDNAKNSLYLQMNSLRAEDTAV YYCARDRYNWNYRAFDIWGQGTMVTVSS | 746 | SSELTQDPAVSVALGQTVRITCQGDSLRSYY ASWYQQKPGQAPVLVIYGKNNRPSGIPDRFS GSSSGNTASLTITGAQAEDEADYYCNSRDSS GNHLVFGTGTKVTVL |
| 559 | EVQLVESGGGLVQPGGSLRLSCAASGFTFSS YWMSWVRQAPGKGLEWVANIKQDGSEKYYVD SVKGRFTISRDNAKNSLYLQMNSLRAEDTAV YYCARDLGRGTISWFDPWGQGTLVTVSS | 747 | SSELTQDPAVSVALGQTVRITCQGDSLRSYY ASWYQQKPGQAPVLVIYGKNNRPSGIPDRFS GSSSGNTASLTITGAQAEDEADYYCNSRDSS GNHWVFGGGTKLTVL |
| 560 | QITLKESGPTLVKATQTLTLTCTFSGFSLNS SGVGVVWIRQPPGKALEWLALIYWNGDKRYS QSLKNRLTITEDTSKNQVVLAMTNMDPVDTA TYYCTQTGYDSRWSFAYWGQGTLVTVSS | 748 | SYVLTQPPSVSVAPGKTARITCGGNNIGSKS VHWYQQKPGQAPVLVIYYDSDRPSGIPERFS GSNSGNTATLTISRVEAGDEADYYCQVWDSS SDHWVFGGGTKLTVL |
| 561 | QGQLVQSGAEVKKPGASVKVSCKTSGYIFMN YGITWVRHAPGQGLEWMGWISAYNGNTNYAQ KVQGRVTMTDTSTSTANMELRSLRSDDTAV YYCAREGQWRGRGWFALWGQGTQVTVSS | 749 | SSELTQDPAVSVALGQTVRITCQGDSLRSYY ASWYQQKPGQAPVLVIYGKNNRPSGIPDRFS GSSSGNTASLTITGAQAEDEADYYCNSRDSS GNHLVFGGGTKLTVL |
| 562 | QVQLVQSGSELKKPGASVKVSCKASGYTFTN YAMNWVRQAPGQGLEWMGWINTNTGKPTYAQ GFTGRFVFSLDTSVSTAHLQISGLKAEDTAV YYCARERYFEDFHYMDVWGKGTTVTVSS | 750 | SSELTQDPAVSVALGQTVRITCQGDSLRSYY ASWYQQKPGQAPVLVIYGKNNRPSGIPDRFS GSSSGNTASLTITGAQAEDEADYYCNSRDSS GNHLVFGGGTKLTVL |
| 563 | QVQLVQSGAEVKKPGASVKVSCKASGYTFTD NYIHWVRRAPGQGLEWMGWLNPNSGGTNFAQ KFQGRVTMTRDTSISSVYMILSSLRSDDTAV YYCARSSWLQLTYYFDYWGQGTLVTVSS | 751 | SSELTQDPAVSVALGQTVRITCQGDSLRSYY ASWYQQKPGQAPVLVIYGKNNRPSGIPDRFS GSNSGNTASLTITGAQAEDEADYYCNSRDSS GNHLLFGGGTKLTVL |

TABLE 5-continued

Full Heavy Chain (HC) and Light Chain (LC) Sequences for Anti-EPOR
Antibodies

| SEQ ID NO | Full HC AA sequence | SEQ ID NO | Full LC AA sequence |
|---|---|---|---|
| 564 | QVQLVQSGAEVKKPGASVKVSCKASGYTFTS YYIHWVRQAPGQGLEWMGIINPSGGSTSYAQ KFQGRVTMTRDTSTSTVYMEVSSLRSEDTAV YYCAREGLQLGSNWFDPWGQGTLVTVES | 752 | SSELTQDPGVSVALGQTVRITCQGDSLRSYY ASWYQQKPGQAPVLVMYGKKNRPSGIPDRFS GSSSGNTASLTITGAQAEDEADYYCKSRDSS GNHVVFGGGTKLTVL |
| 565 | EVQLVESGGGLVQPGGSLRLSCAASGFTFSS YSMNWVRQAPGKGLEWVSYISSSSSTIYYAD SVKGRFTISRDNAKNSLYLQMNSLRDEDTAV YYCARNDILTGEDAFDIWGQGTMVTVSS | 753 | SYELTQPPSVSVSPGQTARITCSGDALPKKY AYWYQQKSGQAPVLVIYEDSKRPSGIPERFS GSSSGTMATLTISGAQVEDEADYYCYSTDSS GNHRVFGGGTKLTVL |
| 566 | EVQMVESGGGLVQPGGSLRLSCAASGFTFSN YAMSWVRQAPGKGLGWVSGISGSGGRTYYAD SVKGRFTISRDNSKNTLYLQMNSLRAEDTAV YYCAKESIIVGATMFDYWGQGTLVTVSS | 754 | SSELTQDPAVSVALGQTVRITCQGDSFRNYY ASWYQQMPGQAPVLVIYGKNNRPSGIPDRFS GSSSGNTASLTITGAQAEDEADYYCNSRDSS GNHWVFGGGTKLTVL |
| 567 | QVQLVESGGGVVQPGRSLRLSCAASGFTFSS YGMHWVRQAPGKGLEWVAVISYDGSNKYYAD SVKGRFTISRDNSKNTLYLQMNSLRAEDTAV YYCAKGIAALGYYYMDVWGKGTTVTVSS | 755 | SSELTQDPAVSVALGQTVRITCQGDSLRSYY ASWYQQKPGQAPVLVIYGKNNRPSGIPDRFS GSSSGNTASLTITGAQAEDEADYYCNSRDSS GNHLVFGGGTKLTVL |
| 568 | EVQLVQSGAEMKKPGESLKISCKDSGYRFSN YWIGWVRQLPGKGLEWMGIIYPGDSDTRYSP SFQGQVTISADKSINTAYLQWNSLKASDTAI YYCAKRRITGSHNWFDPWGQGTLVTVSS | 756 | SSELTQDPAVSVALGQTVRITCQGDSLRSYY ASWYQQKPGQAPVLVIYGKNNRPSGIPDRFS GSSSGNTASLTITGAQAEDEADYYCNSRDSS GNHLVFGGGTKLTVL |
| 569 | QVQLVQSGSELKKPGASVKVSCKASGYTFTS YAMNWVRQAPGQGLEWMGWINTNTGNPTYAQ GFTGRFVFSLDTSVSTAYLQISSLKAEDTAV YYCARGGTIFGVVNFDYWGQGTLVTVSS | 757 | QTVVTQEPSLTVSPGGTVTLTCASSTGAVTS GYYPNWFQQKPGQAPRALIYSTSNKHSWTPA RFSGSLLGGKAALTLSGVQPEDEAEYYCLLY YGGARVFGGGTKLTVL |
| 570 | QVQLVESGGGVVQPGRSLRLSCAASGFTFSS YVMHWVRQAPGKGLEWVAVIWYDGSNKYFAD SVKGRFTISRDNSNNTLYLQMNSLRAEDTGV YYCLSRSGYSAHNDGDYWGQGTLVTVSS | 758 | QSALTQPASVSGSPGQSITISCTGTSSDVGV YNFVSWYQQHPGKAPKLMIYDVTKRPSGASE RFSGSKSGSTASLTISGLQAEDEADYYCCSY AGSSTWVFGGGTKLTVL |
| 571 | QVQLVQSGAEVKKPGASVKVSCKASGYTFTG YYIFWVRQAPGQGLEWMGWINPNSGGTNYAQ KFQGRVTMTRDTSITTAYMELSRLHDDTAV YYCTKEGLVVRPDWFDPWGQGTLVTVSS | 759 | QSVLTQPPSVSGAPGQRVTISCTGSSSNIGA GYDVHWYQQLPGTAPKILIYVNNNRPSGVPD RFSGSKSGTSASLAITGLQAEDEADYYCQSY DSSLSGPVFGGGTKLTVL |
| 572 | QVQLQQSGPGLVKPTQTLSLTCAISGDSVSS NSAAWNWIRQSPSRGLEWLGRTYYRSKWYND YAVSVRSRITINPDTSKNQFSLHLNSVTPED TAVYYCARKGRDVFDIWGQGTMVTVSS | 760 | QSALTQPASVSGSPGQSITISCTGTSSDVGG YNYVSWYQQHPGKAPKLMIYDVSKRPSGVSN RFSGSKSGNTASLTISGLQAEDETDYYCCSY AGSSTYWVFGGGTKLTVL |
| 573 | QVQLVQSGAEVKKPGASVKVSCKASGYTFTS YGISWVRQAPGQGLEWMGWISAYNGNTNYAQ KLQGRVTMTDTSTSTAYMELRSLRSDDTAV YYCAREGSGSYSDAFDIWGQGTMVTVSS | 761 | QSVLTQPPSVSGAPGQRVTISCTGSSSNIGA GYDVHWYQQLPGTAPKLLIYGNSNRPSGVPD RFSGSKSGTSASLAITGLQAEDEADYYCQSY DSSLSGSYVFGTGTKVTVL |
| 574 | QITLKESGPTLVKPTQTLTLTCTFSGFSITT SGVGVGWIRQPSGKALEWLALIYWNDDKRYS PSLKSRLTITKDTSKNQVVLTMTNMDPVDTA TYYCTHTEYRNTWCVDYWGQGTLVTVSS | 762 | QAVLTQPASLSASPGASASLTCTLRSGIHVD TSRIYWYQQKPGSPPQYLLRYKSDSDKHQDS GVPSRFSGSKDASTNAGILLISGLQSEDEAD YYCMIWHSSAIVFGGGTKLTVL |
| 575 | QITLKESGPTLVKPTQTLTLTCTFSGFSLST SGVGVGWIRQPPGKALEWLALIYWNDDKRYS PSLKSRLTITKDTSKNQVVLTMTNMDPVDTA TYYCAHSPYTSGWPFDYWGQGTLVTVSS | 763 | QAVLTQPASLSASPGASASLTCTLRSGINVG SYRIYWFQQRPGSPPQYLLRYKSDSDKQQGS GVPSRFSGSKDASANAGILLISGLQSEDEAD YYCMIWHSSASVFGGGTKVTVL |
| 576 | QVQLVQSGAEVKKPGASVKVSCKASGYTFTS YDINWVRQATGQGLEWMGWMNPNSGNTGYAQ KFQGRVTMTRNTSISTAYMELSSLRSEDTAV YYCARVSYSSSWSLFDYWGQGTLVTVSS | 764 | QAVLTQPASLSASPGASASLTCTLRSGINVG TYRIYWYQQKPGSPPQYLLRYKSDSDKQQGS GVPSRFSGSKDASANAGILLISGLQSEDEAD YYCMIWHSSAWVFGGGTKLTVL |
| 577 | QVTLRESGPALVKPTQTLTLTCTFSGFSLST SGMSLSWIRQPPGKALEWLALIDWDDDQYYS TSLKTRLTISKDTSKNQVVLSMTNMDPVDTA TYYCARIRGVGALDGFDFWGQGTMVTVSS | 765 | SSELTQDPAVSVALGQTVRITCQGDSLRSYY ASWYQQKPGQAPVLVIYGKNNRPSGIPDRFS GSSSGNTASLTITGAQAEDEADYYCNSRDSS GNHLVFGGGTKLTVL |
| 578 | QVQLVQSGAEVKKPGASVKVSCKASGYTFTS YGISWVRQAPGQGLEWMGWISGYKGNTNCAQ ELQGRVTITSDTSTSTAYMELRSLRSDDTAV YYCARPLDYGDYEGWEDPWGQGTLVTVSS | 766 | SSELTQDPAVSVALGQTVRITCQGDSLRSYY ASWYQQKPGQAPVLVIYGKNNRPSGIPDRFS GSSSGNTASLTITGAQAEDEADYYCNSRDSS GNHLVFGGGTKLTVL |

TABLE 5-continued

Full Heavy Chain (HC) and Light Chain (LC) Sequences for Anti-EPOR
Antibodies

| SEQ ID NO | Full HC AA sequence | SEQ ID NO | Full LC AA sequence |
|---|---|---|---|
| 579 | QVQLAQSGIEMRKPGASVKVSCRASGDTFTN CGFGWVRQAPGQGLEWMGWISAYNGNTNYAQ KFQGRVTMTTDTSTSTAYMELRSLRSDDTAV YYCAREGRTNYFYYYMDVWGKGTTVTVSS | 767 | SSELTQDPTVSVALGQTVRITCQGDSLRSYY ASWYQQKPGQAPVLVIYGKNNRPSGIPDRFS GSSSGNTASLTITGAQAEDEADYYCNSRDSS GNHWVFGGGTKLTVL |
| 580 | EVQLVESGGGLVQPGRSLRLSCAASGFTFDD YAMHWVRQAPGKGLEWVSGISKNSGSIGYAD SVKGRFTISRDNAKKSLYLQMNSLRVEDTAL YYCAKDITASGDYYYMDVWGKGTTVTVSS | 768 | SSELTQDPAVSVALGQTVRITCQGDSLRSYY ASWYQQKPGQAPVLVIYGKNNRPSGIPDRFS GSSSGNTASLTITGAQAEDEADYYCNSRDSS GNHLVFGGGTKLTVL |
| 581 | EVQLVESGGGLVQPGGSLRLSCAASGFTFSS YSMNWVRQAPGKGLEWVSYISSSSSTIYFAD SVKGRFTISRDNAKNSLYLQMNSLRDEDTAV YYCARDRVYNWNDGAFDIWGQGTMVTVSS | 769 | SSELTPDDPAVSVALGQTVRITCQGDSLRSYY ASWYQQKPGQAPILVIYHKNNRPSGIPDRFS GSSSGNTASLTITGAQAEDEADYYCNSRDSS GNHVVFGGGTKLTVL |
| 582 | EVQLVESGGGLVQPGGSLRLSCAASGFTFSS YAMSWVRQAPGKGLEWVSAISGSGGSTYYAD SVKGRFTISRDNSKNTMYLQMNSLRAEDTAV YYCAKDQRYNWNSWYFDLWGRGTLVTVSS | 770 | SSELTQDPAVSVALGQTVRITCQGDSLRSYY ASWYQQKPGQAPVLVIYGKNNRPSGIPDRFS GSSSGNTASLTITGAQAEDEADYYCNSRDSS GNHLVFGGGTKLTVL |
| 583 | QVQLVESGGGVVQPGRSLRLSCAASGFTFSS YGMHWVRQAPGKGLEWVAVIWYDGSNKYYAD SVKGRFTISRDNSKNTLYLQMNSLRAEDTAV YYCARDHGGVTTYNWFDPWGQGTLVTVSS | 771 | SYELTQPPSVSVSPGQTARITCSGDALPKKY AYWYQQKSGQAPVLVIYEDSKRPSGIPERFS GSSSGTMATLTISGAQVEDEADYYCYSTDSS GNHRVFGGGTKLTVL |
| 584 | QVQLVQSGAEVKKPGASVKVSCKASGYTFTG YYMHWVRQAPGQGLEWMGWINPNSGGTNYAQ KFQGRVTMTRDTSISTAYMELSRLRSDDTAV YYCARDRMVRGVLDAFDIWGQGTMVTVSS | 772 | QSALTQPPSASGSPGQSVTISCTGTSSDVGG YNYVSWYQQHPGKAPKLMIYEVSKRPSGVPD RFSGSKSGNTASLTVSGLQAEDEADYYCSSY AGSNNVVFGGGTKLTVL |
| 585 | EVQLVESGGGLVQPGGSLRLSCAASGFTFSS YSMNWVRQAPGKGLEWVSYISSSSSTIYYAD SVKGRFTISRDNAKNSLYLQMNSLRDEDTAV YYCVRGYSSGWYNWYFDLWGRGTLVTVSS | 773 | QSALTQPPSASGSPGQSVTISCTGTSSDVGG YNYVSWYQQHPGKAPKLMIYEVSKRPSGVPD RFSGSKSGNTASLTVSGLQAEDEADYYCSSY AGSNNLVFGGGTKLTVL |
| 586 | QVQLVESGGGLVKPGGSLRLSCAASGFTFSD YYMSWIRQAPGKGLEWVSYISSSGSTIYYAD SVKGRFTISRDNAKNSLYLQMNSLRAEDTAV YYCARKVPGIAAAGAFDYWGQGTLVTVSS | 774 | QTVVTQEPSLTVSPGGTVTLTCASSTGAVTS GYYPNWFQQKPGQAPRALIYSTSNKHSWTPA RFSGSLLGGKAALTLSGVQPEDEAEYYCLLY YGGAQLVFGGGTKLTVL |
| 587 | QVQLVQSGSELKKPGASVKVSCKASGYTFNS YAMNWVRQAPGLGLEWMGWINTNTGNPTYAQ GFSGRFVFSLDTSVNTAYLQISSLQAEDTAV YFCARGGYGYNFWIRFDPWGQGTLVTVSS | 775 | QSVLTQPPSVSGAPGQRVTISCTGSNSNIGA GYDIHWYQQLPVTAPKLLIYGNSNRPSGVPD RFSGSKSGSSASLAITGLQAEDEADYYCQSY DNSLSGSVFGGGTKLTVL |
| 588 | QLQLQESGPGLVKPSETLSLTCTVSGGSISR SSYYWGWIRQPPGRGLEWIGSIYYSGSTYYN PSLKSRVTISVDTSKNQFSLKLSSVTAADTG VYYCASYWNFDYWGRGTLVTVSS | 776 | SYELTQPPSVSVSPGQTARITCSGDVLAKKF ARWFQQKPGQAPLLVIYKDSERPSGIPERFS GSNSGTTVTLTISGAQVEDEADYYCYSAADN NLVFGGGTKLTVL |
| 589 | QVQLQESGPGLVKPSGTLSLTCAVSGGSISS SFWLSWVRQPPGKGLEWIGEIYHSGSTNYNP SLKSRVTISVDKSKNQFSLKLTSVTAADTAV YSCARVLGYSYGYRRWFDPWGQGTLVTVSS | 777 | SYELTQPPSVSVSPGQTARITCSGDALPKKY AYWYQQKSGQAPVLVIYEDSKRPSGIPERFS GSSSGTMATLTISGAQVEDEADYYCYSTDSS GNHRVFGGGTKLTVL |
| 590 | EVQLVESGGGLVNPGGSLRLSCAASGFTFSN AWMSWVRQGPGRGLEWVGRIKSKSDGETIDY AAPVKGRFSFSRDDAENTLYLEMNSLKTEDT AVYYCTTEGSFNFYYFMDVWGKGTAVTVSS | 778 | SHMLTQPPSVSVAPGTTARITCGGNNFGSKS VHWYQQKPGQAPVLVIYYDSDRPSGIPERFS GSNSGNTATLTISRVEAGDEADYYCQVWDST SDHYVFGTGTKVTVL |
| 591 | QVQLQESGPGLVKPSETLSLTCTVSGGSISS YYWSWIRQPPGKGLEWIGHIYYSGSTNYNPS LKSRVTISVDTSKNQFSLKLSSVTAADTAVY YCARDPFYYDFSDYYYMDVWGKGTTVTVSS | 779 | QSALTQPASVSGSPGQSITISCTGTSSDVGA YNYVSWYQQHPGKAPKLMIYAVSKRPSGVSY RFSGSKSGNTASLTISGLQAEDEADYYCCSY AGTISWVFGGGTKLTVL |
| 592 | EVQLVESGGGLVQPGGSLRLSCAASGFTFSS YAMSWVRQAPGKGLEWVSAISGSGGSTYYAD SVKGRFTISRDNSKNTLYLQMNSLRAEDTAV YYCAKNEARDYYGSGSFDYWGQGTLVTVSS | 780 | QSALTQPASVSGSPGQSITISCTGTSSDVGG YNYVSWYQQHPGKAPKLMIYDVSKRPSGVSN RFSGSKSGNTASLTISGLQAEDEADYYCCSY AGSSTYVFGTGTKVTVL |
| 593 | EVQLVESGGGVVRPGGSLRLSCAASGFTFGD FGMSWVRQAPGKGLEWVSGINWNGGSTGYAD SVKGRFTISRDNAKNSLYLQMNSLRAEDTAL YYCASLVGATDYYFYYMDVWGKGTTVTVSS | 781 | QSALTQPPSASGSPGQSVTISCTGTSSDVGG YNYVSWYQQHPGKAPKLMIYEVNKRPSGVPD RLSGSKSGNTASLTVSGLQAEDEADYYCSSY AGSNNWVFGGGTKLTVL |

TABLE 5-continued

Full Heavy Chain (HC) and Light Chain (LC) Sequences for Anti-EPOR
Antibodies

| SEQ ID NO | Full HC AA sequence | SEQ ID NO | Full LC AA sequence |
|---|---|---|---|
| 594 | QVQLQQSGPGLVKPSQTLSLTCAISGDSVSS NSAAWNWIRQSPSRGLEWLGRTYYRSKWYND YAVSVKSRITINPDTSKNQFSLQLNSVTPED TAVYYCARKWELLDAFDIWGQGTMVTVSS | 782 | QSALTQPASVSGSPGQSITISCTGTSSDVGG YNYVSWYQQHPGKAPKLMIYDVSKRPSGVSN RFSGSKSGNTASLTISGLQAEDEADYYCCSY AGSSTWVFGGGTKLTVL |
| 595 | EVQLVESGGGLVQPGGSLRLSCAASGFTFSS YSMNWVRQAPGKGLEWVSYISSSSSTIYYAD SVKGRFTISRDNAKNSLYLQMNSLRDEDTAV YYCAREERDDYSNYGYFQHWGQGTLVTVSS | 783 | QSVLTQPPSVSGAPGQRVTISCTGSSSNIGA GYDVHWYQQLPGTAPKLLIYGNSNRPSGVPD RFSGSKSGTSASLAITGLQAEDEADYYCQSY DSSLSGWVFGGGTKLTVL |
| 596 | QVQLQQSGPGLVKPSQTLSLTCAISGDSVSS NSATWNWIRQSPSRGLEWLGRSYYMSKWYND YAVSVKSRITINPDTSKNQFSLQLNSVTPED TAVYYCARGDWNYGVLDSWGQGTLVTVSS | 784 | QSALTQPPSVSGSPGQSVTISCTGTSSDVGS YNRVSWYQQPPGTAPKLMIYDVSNRPSGVPD RFSGSKSGNTASLTISGLQAEDEADYYCSSY TSSSTYVVFGGGTKLTVL |
| 597 | QVQLVQSGAEVKKPRASVKVSCEASGYTFTT YGISWVRQAPGQGLEWMGWISAYNGNTKYTQ KLQGRVAMTTDTSTSTAYMEVRSLRSDDTAV YYCARSGYNWNYDYYFMDVWGTGTTVTVSS | 785 | QSILTQPPSVSATPGQRVTISCTGSDSNIGA GYDVHWYQQLPGAVPRLLIHDNIIRPSGVPD RFSGSKSDTSASLAISGLHAEDEADYYCQSY DISLSGSVVFGGGTKLTVL |
| 598 | EVQLVESGGGVVRPGGSLRLSCAASGFTFDD YGMSWVRQAPGKGLEWVSGINWNGGSTGYAD SVKGRFTISRDNAKNSLYLQMNSLRAEDTAL YYCARDGCSSTSCYGNWFDPWGQGTLVTVSS | 786 | SYELTQPPSVSVSPGQTASITCSGDKLGDKY ACWYQQKPGQSPVLVIYQDSKRPSGIPERFS GSNSGNTATLTISGTQAMDEADYYCQAWDSS TAVFGGGTKLTVL |
| 599 | QVQLQQSGPGLVKPSQTLSLTCAISGDSVSS NSAAWNWIRQSPSRGLEWLGRTYYRSKWYSD YAVSVKSRITINPDTSKNQFSLQLNSVTPED TAVYYCARVDFGIVGAIDYWGQGTLVTVSS | 787 | SYELTQPPSVSVSPGQTARITCSGDGLSKKY AYWYQQKSGQAPVLVIYEDSKRPSGIPERFS GSSSGTMATLTVSGAQVEDEADYYCYSTDSS GKIFGGGTKLTVL |
| 600 | EVQLVESGGGLVKPGGSLRLSCAASAFTFSN YNMNWVRQAPGKGLEWVSSISSSTSYIYYAD SVKGRFTVSRDNAKNSLYLQMNSLRAEDTAV YYCARDRDDFWSGYSPYFDYWGQGTLVTVSS | 788 | SSELTQDPAVSVALGQTVRITCQGDSLRSYY ASWYQQKPGQAPVLVIYGKNNRPSGIPDRFS GSSSGNTASLTITGAQAEDEADYYCNSRDSS GNHWVFGGGTKLTVL |
| 601 | EVQLVESGGGLVKPGGSLRLSCAASGFTFSS YSMNWVRQAPGKGLEWVSSISSSSSYIYYAD SVKGRFTISRDNAKNSLYLQMNSLRAEDTAV YYCAREKYDILTGYSPYFDYWGQGTLVTVSS | 789 | SSELTQDPAVSVALGQTVRITCQGDSLRSYY ASWYQQKPGQAPVLVIYGKNNRPSGIPDRFS GSSSGNTASLTITGAQAEDEADYYCNSRDSS GNHWVFGGGTKLTVL |
| 602 | EVQLVESGGGLVKPGGSLRLSCAASGFTFSN AWMSWVRQAPGKGLEWVGRIKSKTDGGTTDY AAPVKGRFTISRDDSKNTLYLQMNSLKTEDT AVYYCTTDQVSGSYGDAFDIWGQGTMVTVSS | 790 | SYELTQPPSVSVSPGQTARITCSGDALPKKY AYWYQQKSGQAPVLVIYEDSKRPSGIPERFS GSSSGTMATLTISGAQVEDEADYYCYSTDSS GNHRVFGGGTKLTVL |
| 603 | EVQMVESGGGLVQPGGSLRLSCAASGFTFSS HVMSWVRQAPGKGLEWVSVISGSESSTYYAD SVKGRFTISSDNSKNTLYLQMNSLRAEDTAI YYCAKRAGSGTYYRGYYFDYWGQGTLVTVSS | 791 | SSELTQDPAVSVALGQTVRITCQGDSLRSYY ASWYQQKPGQAPVLVIYGKNNRPSGIPDRFS GSSSGNTASLTITGAQAEDEADYYCNSRDSS GNHWVFGGGTKLTVL |
| 604 | LVQLVESGGGVVQPGRSLRLSCAASGFTFSS YGMHWVRQAPGKGLEWVTLIWYDGSNTYYAE SVKGRFTISRDNSKSTLYLHMNSLRAEDSAV YYCAGTYYYDSSGYLNYMDVWGKGTTVTVSS | 792 | SSELTQDPAVSVALGQTVRITCQGDSLRSYY ASWYQQKPGQAPVLVIYGKNNRPSGIPDRFS GSSSGNTASLTITGAQAEDEADYYCNSRDSS GNHLVFGGGTKLTVL |
| 605 | QLQLQESGPGLVKPSETLSLTCTVSGGSISS SSYYWGWIRQPPGKGLEWIGSIHYSGSTYYN PSLKSRVTTSVDTSKNQFSLKLSSVTAADTA VYYCASEGPYFDYWGQGTLVTVSS | 793 | SSELTQDPAVSVALGQTVRITCQGDSLRSYY ASWYQQKPGQAPVLVIYGKNNRPSGIPDRFS GSSSGNTASLTITGAQAEDEADYYCNSRDSS GNHWVFGGGTKLTVL |
| 606 | QVQLVQSGAEVKKPGASVKVSCKASGYSFSS YGIGWVRQAPGQGLEWMGWISGYNGNTNYAQ KFQGRVTMTTDTSTSTAHMEVKSLRSDDTAA YYCARAYCGGDCYYSNAFDAWGQGTMVTVSS | 794 | QSALTQPASVSGSPGQSITISCTGTSSDVGG YNYVSWYQQHPGKAPKLMIYEVSNRPSGVSN RFSGSKSGNTASLTISGLQAEDEADYYCSSY TSSSTVVFGGGTKLTVL |
| 607 | EVQLVESGGGLVKPGGSLRLSCAASGFTFSN AWMSWVRQAPGKGLEWVGRIKSKTDGGTTDY AAPVKGRFTISRDDSKNTLYLQMNSLKTEDT AVYYCTTDRVTIFGLARMDVWGKGTTVTVSS | 795 | QSALTQPASVSGSPGQSITISCTGTSSDVGG YNYVSWYQQHPGKAPKLMIYDVSKRPSGVSN RFSGSKSGNTASLTISGLQAEDEADYYCCSY AGSSTWVFGGGTKLTVL |

TABLE 5-continued

| | Full Heavy Chain (HC) and Light Chain (LC) Sequences for Anti-EPOR Antibodies | | |
| --- | --- | --- | --- |
| SEQ ID NO | Full HC AA sequence | SEQ ID NO | Full LC AA sequence |
| 608 | EVQLVESGGGLVQPGGSLRLSCAASGFTEST YSVKWVRQAPGKGLEWVSYISSGSSTIYYAD SVKGRFTISRDNAKNSLYLQMNSLRDEDTAV YYCARDPTTIFGVVPYYYMDVWGTGTTVTVS S | 796 | SSELTQDPAVSVALGQTVRITCQGDSLRSYY ATWYQQKPGQAPVLVIYGRNNRPSGIPDRFS GSSSGNTASLTITGAQAEDEADYYCYSRDSS GNHLVFGGGTNLTVL |
| 609 | EVQLVESGGGLVKPGGSLRLSCAASGFTFSN AWMSWVRQAPGKGLEWVGRIKSKTDGGTTDY AAPVKGRFTISRDDSKNTLYLQMNSLKTEDT AVYYCTTDRDYYGSGSYYFDYWGQGTLVTVS S | 797 | SYVLTQPPSVSVAPGKTARITCGGNNIGSKS VHWYQQKPGQAPVLVIYYDSDRPSGIPERFS GSNSGNTATLTISRVEAGDEADYYCQVWDSS SDHRVFGGGTKLTVL |
| 610 | QLQLQESGPGLVKPSETLSLTCTVSGGSITT RSYYWGWLRQPPGKGLEWIGTFYYSGNTYYN PSLQSRVSISVDASKNQFSLQLSSVTAADTA VFYCAREDLIGNDYWGQGTLVTVSS | 798 | SSELTQDPAVSVALGQTVRITCQGDSLRSYY ASWYQQKPGQAPVLVIYGKNNRPSGIPDRFS GSSSGNTASLTITGAQAEDEADYYCNSRDSS GNHLVFGGGTKLTVL |
| 611 | QVHLQQSGPGLVKPSQTLSLTCAISGDSVSS NSAAWNWIRQSPSRGLEWLGRTYYRSKWYND YAVSVKSRITINSDTKNQFSLQLNSVTPED TAVYYCSRDRLIVGASYFDLWGRGTLVTVSS | 799 | SSELTQDPAVSVALGQTVRITCQGDSLRSYY ASWYQQKPGQAPVLVFYGKNKRPSGIPDRFS GSSSGNTASLTITGAQAEDEADYYCNSRDSN GNHWVFGGGTKLSVL |
| 612 | EVQLVESGGGVVRPGGSLRLSCAASGFTFDD YGMSWVRQAPGKGLEWVSGINWNGGSTGYAD SVKGRFTISRDNAKNSLYLQMNSLRAEDTAL YYCAREKAPAHRSSWSWYFDLWGRGTLVTVS S | 800 | QSALTQPASVSGSPGQSITISCTGTSSDVGG YNYVSWYQQHPGKAPKLMIYDVSKRPSGVSN RFSGSKSGNTASLTISGLQAEDEADYYCCSY AGSSWVFGGGTKLTVL |
| 613 | QVQLVHSGAEVKKPGASVKVSCKASGYTFTG NYIHWVRQAPGQGLEWMGWINPTSGVTNYAQ KFQGRVTLTRDTSISTAYMELSRLRSDDTAV YYCTREGIAAANPGYFYYMDVWGKGTTVTVS S | 801 | QPVLTQPPSVSGVPGQRVTISCTGSSSNIGA RYDVHWYQQLPGTAPKLLIYGNSNRPSGVPD RFSGSKSGTSASLAITGLQAEDEADYYCQSY DGTLGGWIFGGGTNLTVL |
| 614 | QVQLVQSGAEVKKPGASVKVSCKASGYTFTD YYMHWVRQAPGQGLEWMGWINPNSGGTNYAQ KFQGRVTMTRDTSISTAYMELSRLRSDDTAV YFCARCDMVRGVIDHYYNYMDVWGKGTTVTV SS | 802 | SSELTQDPAVSVALGQTVRITCQGDSLRSYY ASWYQQKPGQAPVLVIYGKNNRPSGIPDRFS GSSSGNTASLTITGAQAEDEADYYCNSRDSS GNHWVFGGGTKLTVL |
| 615 | QMQLQGSGPGLMKPSETLSLTCTVSGGSISS RSYYWGWIRQPPGKGLEWIGSVFYSGSTYYN PSLKSRVTISVDTSKNQFSLKVISVTAADTA VYYCVRQTYDSWTGYSFFYFDYWGQGTLVTV SS | 803 | QSALTQPASVSGSPGQSITISCTGTSSDVGG YNYVSWYQQHPGKAPKLMIYDVSKRPSGVSN RFSGSKSGNTASLTISGLQAEDEADYYCCSY AGSSWVFGGGTKLTVL |
| 616 | EVQLVESGGGLVQPGGSLKLSCAASGFTFSG SAMHWVRQASGKGLEWVGRIRSKANSYATAY AASVKGRFTISRDDSKNTAYLQMNSLKTEDT AVYYCTRPMITFGGVIVYDAFDIWGQGTMVT VSS | 804 | SYELTQPPSVSVSPGQTASITCSGDKLGDKY ACWYQQKPGQSPVLVIYQDSKRPSGIPERFS GSNSGNTATLTISGTQAMDEADYYCQAWDSS TVIFGGGTKLTVL |
| 617 | QVQLQQWGAGLLKPSETLSLTCAVYGGSFSG YYWSWIRQPPGKGLEWIGEINHSGSTNYNPS LKSRVTISVDTSKNQFSLKLSSVTAADTAVY YCARGWGSSSWYYFDYWGQGTLVTVSS | 805 | SYELTQPPSVSVSPGQTARITCSGDALPKKY AYWYQQKSGQAPVLVIYEDNKRPSGIPERFS GSSSGTMATLTISGAQVEDEADYYCYSTDSS GNHRVFGGGTKLTVL |
| 618 | QVQLQQWGAGLLKPSETLSLTCAVYGGSFSG YYWSWIRQPPGKGLEWIGEINRSGSTNYNPS LKTRVTISVDTSKNQFSLQLSSVTAADTAVY YCARGIFGVGGNWFDPWGQGTLVTVSS | 806 | SSELTQDPAVSVALGQTVRITCQGDSLRNYY ASWYQQKPGQAPVIVIYGKNNRPSGIPDRFS GSSSGNTASLTITGAQAEDEADYYCNSRDSS GNHLVFGGGTKLTVL |
| 619 | QLQLQESGPGLVKPSETLSLTCTVSGGSISS SSYYWGWIRQPPGKGLEWIGSIYYSGSTYYN PSLKSRVTISVDTSKNQFSLKLSSVTAADTA VYYCARYSSSWSGFDYWGQGTLVTVSS | 807 | QSALTQPPSASGSPGQSVTISCTGTSSDVGG YNYVSWYQQHPGKAPKLMIYEVSKRPSGVPD RFSGSKSGNTASLTVSGLQAEDEADYYCSSY AGSNNFGGGTKLTVL |
| 620 | QLQLQESGPGLVKPSETLSLTCTVSGGSISS SSYYWGWIRQPPGKGLEWIGSIYYSGSTYYN PSLKSRVTISVDTSKNQFSLKLSSVTAADTA VYYCARGGSYYVYFDYWGQGTLVTVSS | 808 | SSELTQDPAVSVALGQTVRITCQGDSLRTYY ASWYQQKPGQAPVLVIYGKNKRPSGIPDRFS GSSSGNTASLTITGAQAEDEADYYCNSRDSS GNHWVFGGGTKLTVL |
| 621 | KVQLVESGGGLVQPGGSLRLSCAASGFTFRS YWMSWVRQAPGKGLEWVANINQDGSEKYYVD | 809 | SYVLTQPPSVSVAPGQTARIICGGDNIGIKN VHWYQQKPGQAPVLVIYDDSDRPSGIPERFS |

TABLE 5-continued

Full Heavy Chain (HC) and Light Chain (LC) Sequences for Anti-EPOR
Antibodies

| SEQ ID NO | Full HC AA sequence | SEQ ID NO | Full LC AA sequence |
|---|---|---|---|
| | SVKGRFTISRDNAKNSLYLHMNSLRAEDTAV YYCSRDTDCSSTSCYFNWNPFFDYWGQGTLV TVSS | | GSNSGNTATLTISRVEAGDEADYCCQVWDSS SDHVVFGGGTKLTVL |
| 622 | QLQLQESGPGLVKPSETLSLTCTVSGGSINS SNFYWGWIRQPPGKGLEWFGSIFYSGFTYYN PSLKSRVTISVDTSKNQFSLKLTSVTAADTA VYYCARGGYSYGLNWFDPWGQGTLVTVSS | 810 | SYELTQPPSVSVSPGQTASITCSGDKLGDKY TCWYQQKPGQSPVLVIYQDIKRPSGIPDRFS GSNSGNTATLTISGTQAMDEADYYCQAWDSS TVVFGGGTKLTVL |
| 623 | QLQLQESGPGLVKPSETLSLTCTVSGGSISS SSYYWGWIRQPPGKGLEWIGSIYYSGSTYYN PSLKSRVTISVDTSKNQFSLKLSSVTAADTA VYYCARTYYDFWSGYLNWFDPWGQGTLVTVS S | 811 | SSELTQDPAVSVALGQTVRITCQGDSLRSYY ASWYQQKPGQAPVLVIYGKNNRPSGIPDRFS GSSSGNTASLTITGAQAEDEADYYCNSRDSS GNHVVFGGGTKLTVL |
| 624 | QVQLQQWGAGLLKPSETLSLTCAVYGGSFSG YYWSWIRQPPGKGLEWIGEINRGGSTNYNPS LKSRVTISVDTSKNQFSLKLSSVTAADTAVY YCARWRNYYDSSGSPYWYFDLWGRGSLVTVS S | 812 | QSALTQPPSASGSPGQSVTISCTGTSSDVGG YNYVSWYQQHPGKAPKLMIYEVSKRPSGVPD RFSGSKSGNTASLTVSGLQAEDEADYYCSSY AGSNNWVFGGGTKLTVL |
| 625 | QLQLQESGPGLVKPSETLSLTCTVSGGSISS SGYYWGWIRQSPGKGLEWIGSFYYSGSTYYN PSLKSRVTISVDTSKNQFSLKLSSVTAADTA VYYCARQGRITMVRGVIPFDYWGQGTLVTVS S | 813 | QSALTQPASVSGSPGQSITISCTGTSSDVGG YNYVSWYQQHPGKAPKLMIYEVSNRPSGVSN RFSGSKSGNTASLTISGLQAEDEADYYCSSY TSSSTLVFGGGTKLTVL |
| 626 | QVQLQQWGAGLLKPSETLSLTCAVYGGSFSG YYWSWIRQPPGKGLEWIGEINHSGSTNYNPS LKSRVTISVDTSKNQFSLKLSSVTAADTAVY YCAGGYCSSTSCRYNWNYGGWFDPWGQGTLV TVSS | 814 | QAVVTQEPSLTVSPGGTVTLTCGSSTGAVTS GHYPYWFQQKPGQAPRTLIYDTSNKHSWTPA RFSGSLLGGKAALTLSGAQPEDEAEYYCLLS YSGARVFGGGTKLTVL |

TABLE 6

H-CDR3 and VL-CDR3 Sequences for Anti-CD131 Antibodies

| clonotype_id | fre-quency | VH Gene | VL Gene | VH-CDR3 AA | SEQ ID NO | VL-CDR3 AA | SEQ ID NO | Full HC AA Sequence SEQ ID NO | Full LC AA Sequence SEQ ID NO |
|---|---|---|---|---|---|---|---|---|---|
| clonotype 8 | 10 | IGHV4-39 | IGLV2-14 | CASLTGDRED YW | 815 | CSSYTSSST VVF | 944 | 1073 | 1202 |
| clonotype 11 | 6 | IGHV3-15 | IGLV3-10 | CTGRPSIAAR HFDYW | 816 | CYSTDSSGN HSVF | 945 | 1074 | 1203 |
| clonotype 14 | 6 | IGHV3-20 | IGLV1-40 | CARERLTIFG VVNYYMDVW | 817 | CQSYDSSLS GWVF | 946 | 1075 | 1204 |
| clonotype 15 | 5 | IGHV3-48 | IGLV3-27 | CARDGWDYW | 818 | CYSAADNNR VF | 947 | 1076 | 1205 |
| clonotype 16 | 5 | IGHV3-13 | IGLV3-10 | CARGYSGSYY GDFDYW | 819 | CYSTDSSGN RVF | 948 | 1077 | 1206 |
| clonotype 17 | 5 | IGHV3-23 | IGLV1-40 | CAKKPPRDSA FDYW | 820 | CQSYDSSLS GSVF | 949 | 1078 | 1207 |
| clonotype 25 | 3 | IGHV1-18 | IGLV2-8 | CARENSGSYY WFDPW | 821 | CSSYAGSNN VVF | 950 | 1079 | 1208 |
| clonotype 27 | 3 | IGHV3-23 | IGLV2-23 | CAKLEYSSPD YW | 822 | CCSYAGSST LVF | 951 | 1080 | 1209 |
| clonotype 36 | 2 | IGHV4-34 | IGLV3-19 | CAREGLLVGA TLDAFDIW | 823 | CNSRDSSGN HLVF | 952 | 1081 | 1210 |

TABLE 6-continued

H-CDR3 and VL-CDR3 Sequences for Anti-CD131 Antibodies

| clonotype_ id | fre- quency | VH Gene | VL Gene | VH-CDR3 AA | SEQ ID NO | VL-CDR3 AA | SEQ ID NO | Full HC AA Sequence SEQ ID NO | Full LC AA Sequence SEQ ID NO |
|---|---|---|---|---|---|---|---|---|---|
| clonotype 37 | 2 | IGHV3- 33 | IGLV3- 21 | CARDTGITMV RGVFDYW | 824 | CQVWDSSSD HPVF | 953 | 1082 | 1211 |
| clonotype 44 | 2 | IGHV1- 18 | IGLV1- 44 | CARDRTGISA AGPSNWFDPW | 825 | CAAWDDSLN GPVF | 954 | 1083 | 1212 |
| clonotype 45 | 2 | IGHV4- 34 | IGLV2- 8 | CARTSLAAAD FDYW | 826 | CSSYAGSNN YVF | 955 | 1084 | 1213 |
| clonotype 47 | 2 | IGHV3- 53 | IGLV1- 36 | CARAPDYYGS GSLFDYW | 827 | CAAWDDRLN GPVF | 956 | 1085 | 1214 |
| clonotype 52 | 2 | IGHV3- 21 | IGLV3- 9 | CASHWGHFDY W | 828 | CQVWDSSTV VF | 957 | 1086 | 1215 |
| clonotype 115 | 1 | IGHV3- 13 | IGLV3- 10 | CARDRTLDYW | 829 | CYSTDSSGN HWVF | 958 | 1087 | 1216 |
| clonotype 116 | 1 | IGHV1- 18 | IGLV2- 8 | CARQIGDYW | 830 | CSAYAGSNN VVF | 959 | 1088 | 1217 |
| clonotype 118 | 1 | IGHV3- 73 | IGLV3- 1 | CTGPFDNW | 831 | CQAWDSSTG VF | 960 | 1089 | 1218 |
| clonotype 119 | 1 | IGHV3- 15 | IGLV3- 25 | CTTGGHYW | 832 | CQSADSSGT WVF | 961 | 1090 | 1219 |
| clonotype 122 | 1 | IGHV3- 43 | IGLV3- 10 | CAKARSFDIW | 833 | CYSTDSSGN HRVF | 962 | 1091 | 1220 |
| clonotype 123 | 1 | IGHV3- 15 | IGLV3- 10 | CRADMDVW | 834 | CYSIDSSGN HRVF | 963 | 1092 | 1221 |
| clonotype 124 | 1 | IGHV3- 20 | IGLV3- 10 | CARDRGFDYW | 835 | CYSTDSSGN HRVF | 964 | 1093 | 1222 |
| clonotype 125 | 1 | IGHV3- 53 | IGLV3- 10 | CARGGDYFDY W | 836 | CYSTDSSGN HRVF | 965 | 1094 | 1223 |
| clonotype 126 | 1 | IGHV1- 18 | IGLV2- 14 | CARGASFDFW | 837 | CSSYTRSST CVF | 966 | 1095 | 1224 |
| clonotype 127 | 1 | IGHV3- 73 | IGLV2- 14 | CTGPFDYW | 838 | CSSYTSSST WVF | 967 | 1096 | 1225 |
| clonotype 128 | 1 | IGHV3- 53 | IGLV2- 23 | CARSFDAFDI W | 839 | CCSYAGSST FVVF | 968 | 1097 | 1226 |
| clonotype 130 | 1 | IGHV3- 21 | IGLV3- 27 | CAGLTGELDY W | 840 | CYSAADNNL VF | 969 | 1098 | 1227 |
| clonotype 132 | 1 | IGHV3- 13 | IGLV3- 25 | CARWGTGGFD YW | 841 | CQSADSSGT WVF | 970 | 1099 | 1228 |
| clonotype 133 | 1 | IGHV3- 21 | IGLV3- 10 | CARREGFFDY W | 842 | CYSTDSSGN HRVF | 971 | 1100 | 1229 |
| clonotype 134 | 1 | IGHV3- 7 | IGLV3- 10 | CARDQLAPDY W | 843 | CYSTDSSGN HRVF | 972 | 1101 | 1230 |
| clonotype 135 | 1 | IGHV3- 23 | IGLV3- 10 | CAKDSSGFDY W | 844 | CYSTDSSGN HRVF | 973 | 1102 | 1231 |
| clonotype 136 | 1 | IGHV3- 23 | IGLV3- 10 | CAKDPQFFDY W | 845 | CYSTDSSGN HRVE | 974 | 1103 | 1232 |
| clonotype 137 | 1 | IGHV3- 23 | IGLV3- 10 | CAKDGTAFDI W | 846 | CYSTDSSGN HRVF | 975 | 1104 | 1233 |
| clonotype 138 | 1 | IGHV3- 33 | IGLV3- 9 | CARDRGWGLD YW | 847 | CQVWDSSTG VF | 976 | 1105 | 1234 |

TABLE 6-continued

H-CDR3 and VL-CDR3 Sequences for Anti-CD131 Antibodies

| clonotype_ id | fre- quency | VH Gene | VL Gene | VH-CDR3 AA | SEQ ID NO | VL-CDR3 AA | SEQ ID NO | Full HC AA Sequence SEQ ID NO | Full LC AA Sequence SEQ ID NO |
|---|---|---|---|---|---|---|---|---|---|
| clonotype 140 | 1 | IGHV3- 30 | IGLV3- 19 | CARGELGDFD YW | 848 | CNSRDSSGN HLVE | 977 | 1106 | 1235 |
| clonotype 141 | 1 | IGHV1- 2 | IGLV7- 43 | CARVLELYFD YW | 849 | CLLYYGGAV VF | 978 | 1107 | 1236 |
| clonotype 143 | 1 | IGHV3- 15 | IGLV1- 44 | CTTRSDFQHW | 850 | CAAWDDSLN GWVE | 979 | 1108 | 1237 |
| clonotype 145 | 1 | IGHV1- 8 | IGLV3- 1 | CARDQELRVF DYW | 851 | CQAWDSSTV VF | 980 | 1109 | 1238 |
| clonotype 146 | 1 | IGHV3- 30 | IGLV3- 1 | CAKASGYGPF DYW | 852 | CQAWDSSTV VF | 981 | 1110 | 1239 |
| clonotype 147 | 1 | IGHV5- 51 | IGLV3- 1 | CARHSSSSHF DYW | 853 | CQAWDSSTV VF | 982 | 1111 | 1240 |
| clonotype 148 | 1 | IGHV3- 21 | IGLV3- 10 | CARDRGNSLF DYW | 854 | CYSTDSSGN HRVF | 983 | 1112 | 1241 |
| clonotype 150 | 1 | IGHV1- 2 | IGLV3- 10 | CARDKSLEWF DYW | 855 | CYSTDSSGN HRVF | 984 | 1113 | 1242 |
| clonotype 151 | 1 | IGHV3- 13 | IGLV3- 10 | CARGDWNYGG FDYW | 856 | CYSTDSSGN HRVF | 985 | 1114 | 1243 |
| clonotype 152 | 1 | IGHV3- 15 | IGLV3- 10 | CTTAPDAFDI W | 857 | CYSTDSSGN HRVF | 986 | 1115 | 1244 |
| clonotype 153 | 1 | IGHV3- 23 | IGLV3- 10 | CASGITGTTG DYW | 858 | CYSTDSSGN HRVF | 987 | 1116 | 1245 |
| clonotype 154 | 1 | IGHV3- 23 | IGLV3- 10 | CAKEGAHDAF DIW | 859 | CYSTDSSGN HRVF | 988 | 1117 | 1246 |
| clonotype 156 | 1 | IGHV3- 23 | IGLV3- 10 | CAKDKGELPF DYW | 860 | CYSTDSSGN HRVF | 989 | 1118 | 1247 |
| clonotype 157 | 1 | IGHV3- 33 | IGLV3- 19 | CAKLGVRDYM DVW | 861 | CNSRDSSGN HWVF | 990 | 1119 | 1248 |
| clonotype 158 | 1 | IGHV3- 20 | IGLV3- 19 | CAREGGGWVF DYW | 862 | CNSRDSSGN HWVF | 991 | 1120 | 1249 |
| clonotype 159 | 1 | IGHV5- 51 | IGLV3- 10 | CARGGGGDPF DYW | 863 | CYSTDSSGN HRVF | 992 | 1121 | 1250 |
| clonotype 160 | 1 | IGHV1- 2 | IGLV2- 14 | CARPYNWNSF DYW | 864 | CSSYTTSST WVF | 993 | 1122 | 1251 |
| clonotype 161 | 1 | IGHV3- 43 | IGLV2- 14 | CAKDNDWNGF DYW | 865 | CNSYTTNTT RVF | 994 | 1123 | 1252 |
| clonotype 162 | 1 | IGHV3- 43 | IGLV2- 14 | CAKDNWNYAF DIW | 866 | CSSYTSSST RVF | 995 | 1124 | 1253 |
| clonotype 164 | 1 | IGHV3- 74 | IGLV5- 45 | CARDLDWTLF DYW | 867 | CMTWHSSAV VF | 996 | 1125 | 1254 |
| clonotype 165 | 1 | IGHV3- 7 | IGLV3- 1 | CAGDYSNYGW FDPW | 868 | CQAWDSSTV F | 997 | 1126 | 1255 |
| clonotype 166 | 1 | IGHV1- 8 | IGLV3- 1 | CARARDSGYY MDVW | 869 | CQAWDSSTV VF | 998 | 1127 | 1256 |
| clonotype 167 | 1 | IGHV3- 33 | IGLV3- 27 | CARATAMVTG IDYW | 870 | CYSAADNNW VF | 999 | 1128 | 1257 |
| clonotype 168 | 1 | IGHV3- 73 | IGLV3- 27 | CTGSSGSYFD YW | 871 | CYSAADNNL VF | 1000 | 1129 | 1258 |

TABLE 6-continued

H-CDR3 and VL-CDR3 Sequences for Anti-CD131 Antibodies

| clonotype_ id | fre- quency | VH Gene | VL Gene | VH-CDR3 AA | SEQ ID NO | VL-CDR3 AA | SEQ ID NO | Full HC AA Sequence SEQ ID NO | Full LC AA Sequence SEQ ID NO |
|---|---|---|---|---|---|---|---|---|---|
| clonotype 169 | 1 | IGHV3- 21 | IGLV3- 10 | CARSPYNWNY VDYW | 872 | CYSTDSSGN HRVF | 1001 | 1130 | 1259 |
| clonotype 170 | 1 | IGHV1- 24 | IGLV3- 10 | CATEGPSTFS FDYW | 873 | CYSTDSSGN HRVF | 1002 | 1131 | 1260 |
| clonotype 171 | 1 | IGHV1- 24 | IGLV3- 19 | CATANWNDEA FDIW | 874 | CNSRDSSGN HLVF | 1003 | 1132 | 1261 |
| clonotype 172 | 1 | IGHV3- 48 | IGLV3- 10 | CARDELTGDA FDIW | 875 | CYSTDSSGN HRVF | 1004 | 1133 | 1262 |
| clonotype 173 | 1 | IGHV3- 15 | IGLV3- 10 | CTTEALGIFD YW | 876 | CYSTDSSGN HRVF | 1005 | 1134 | 1263 |
| clonotype 174 | 1 | IGHV3 -21 | IGLV 7-43 | CARDGSSGEL FDYW | 877 | CLLYYGGAW VF | 1006 | 1135 | 1264 |
| clonotype 175 | 1 | IGHV3 -23 | IGLV 2-8 | CAKHYYDSRS FDYW | 878 | CSSYAGSNN LVF | 1007 | 1136 | 1265 |
| clonotype 176 | 1 | IGHV4 -4 | IGLV 1-40 | CARDFQGTGP FDYW | 879 | CQSYDGSLN GWVF | 1008 | 1137 | 1266 |
| clonotype 178 | 1 | IGHV4- 59 | IGLV3- 19 | CARGRLYSGS FSFDYW | 880 | CKSRDRSGN HWVF | 1009 | 1138 | 1267 |
| clonotype 179 | 1 | IGHV3- 7 | IGLV3- 19 | CARDGGYNWN FFDYW | 881 | CNSRDSSGN HVVF | 1010 | 1139 | 1268 |
| clonotype 180 | 1 | IGHV2- 5 | IGLV3- 19 | CTHRDAAMVY FDYW | 882 | CNSRDSSGN HWVF | 1011 | 1140 | 1269 |
| clonotype 181 | 1 | IGHV1- 18 | IGLV3- 10 | CARWYYGSGS YFDYW | 883 | CYSTDSSGN HRVF | 1012 | 1141 | 1270 |
| clonotype 182 | 1 | IGHV3- 13 | IGLV3- 19 | CARGWNYGSG SCFDNW | 884 | CNSRDISGK HWVF | 1013 | 1142 | 1271 |
| clonotype 183 | 1 | IGHV3- 13 | IGLV3- 10 | CARGFSGTYY GDFDYW | 885 | CYSTDSSGN HWVF | 1014 | 1143 | 1272 |
| clonotype 184 | 1 | IGHV3- 48 | IGLV3- 10 | CAREGEWEPL HMDVW | 886 | CYSTDSSGN HRVF | 1015 | 1144 | 1273 |
| clonotype 185 | 1 | IGHV3- 23 | IGLV3- 10 | CAKSLSGSYV YMDVW | 887 | CYSTDSSGN HRVF | 1016 | 1145 | 1274 |
| clonotype 186 | 1 | IGHV3- 30 | IGLV3- 19 | CAKGFLEWLL GFDYW | 888 | CNSRDSSGN HWVF | 1017 | 1146 | 1275 |
| clonotype 187 | 1 | IGHV3- 11 | IGLV3- 21 | CARDGGSSGY YSDYW | 889 | CQVWDSSSD HVVF | 1018 | 1147 | 1276 |
| clonotype 188 | 1 | IGHV3- 74 | IGLV3- 19 | CTRDLVYSSG WYDYW | 890 | CNSRDSSGN HWVF | 1019 | 1148 | 1277 |
| clonotype 189 | 1 | IGHV3- 74 | IGLV3- 19 | CAREGIKASD AFDIW | 891 | CNSRDSSGS HVVF | 1020 | 1149 | 1278 |
| clonotype 190 | 1 | IGHV3- 43 | IGLV3- 10 | CAKDIDPSIT GTDYW | 892 | CYSTDSSGN HSVVF | 1021 | 1150 | 1279 |
| clonotype 191 | 1 | IGHV3- 11 | IGLV7- 43 | CAGLRHEDWL GFDSW | 893 | CLLYYGGAW VF | 1022 | 1151 | 1280 |
| clonotype 192 | 1 | IGHV3- 23 | IGLV2- 14 | CAKEDNWNYG WFDPW | 894 | CSSYTSSST WVF | 1023 | 1152 | 1281 |
| clonotype 193 | 1 | IGHV3- 13 | IGLV2- 14 | CAREETGTTS WYFDLW | 895 | CSSYTSSST LYVF | 1024 | 1153 | 1282 |

TABLE 6-continued

H-CDR3 and VL-CDR3 Sequences for Anti-CD131 Antibodies

| clonotype_id | fre-quency | VH Gene | VL Gene | VH-CDR3 AA | SEQ ID NO | VL-CDR3 AA | SEQ ID NO | Full HC AA Sequence SEQ ID NO | Full LC AA Sequence SEQ ID NO |
|---|---|---|---|---|---|---|---|---|---|
| clonotype 194 | 1 | IGHV3-48 | IGLV2-14 | CARGYSYGYW YFDLW | 896 | CSSYTSSST PYVF | 1025 | 1154 | 1283 |
| clonotype 195 | 1 | IGHV1-24 | IGLV3-1 | CATPYCSGGS CHFDYW | 897 | CQAWDSSTV VF | 1026 | 1155 | 1284 |
| clonotype 196 | 1 | IGHV3-21 | IGLV3-10 | CARDDYGGNS VYFDYW | 898 | CYSTDSSGN HRVF | 1027 | 1156 | 1285 |
| clonotype 198 | 1 | IGHV3-33 | IGLV3-21 | CVRAARYSGT YIFDYW | 899 | CQVWDSSSY HYVF | 1028 | 1157 | 1286 |
| clonotype 199 | 1 | IGHV3-15 | IGLV3-10 | CTTDPGYSYG VDYW | 900 | CYSTDSSGN HRVF | 1029 | 1158 | 1287 |
| clonotype 200 | 1 | IGHV5-51 | IGLV3-10 | CARPEYSSSS GYFQHW | 901 | CYSTDSSGN HRVF | 1030 | 1159 | 1288 |
| clonotype 201 | 1 | IGHV3-7 | IGLV7-43 | CAREYNWNYE DAFDIW | 902 | CLLYYGGAQ VF | 1031 | 1160 | 1289 |
| clonotype 202 | 1 | IGHV2-5 | IGLV2-23 | CAHRRGSYSN WFDPW | 903 | CCSYAGSST WVF | 1032 | 1161 | 1290 |
| clonotype 203 | 1 | IGHV1-18 | IGLV1-36 | CARTLFGVVK NWFDPW | 904 | CAAWDGRIN EWVF | 1033 | 1162 | 1291 |
| clonotype 204 | 1 | IGHV1-2 | IGLV1-44 | CAREVLGGGD CPFDYW | 905 | CAAWDDSLN GVVF | 1034 | 1163 | 1292 |
| clonotype 205 | 1 | IGHV1-2 | IGLV1-36 | CARSDGGSHY VFFDDW | 906 | CTAWDDRLN GPVF | 1035 | 1164 | 1293 |
| clonotype 206 | 1 | IGHV3-43 | IGLV2-8 | CAKDIAYSSS GHFDYW | 907 | CSSYAGSNN LVF | 1036 | 1165 | 1294 |
| clonotype 207 | 1 | IGHV4-4 | IGLV1-40 | CARAPLTGTT NWEDPW | 908 | CQSYDSSLS GWVF | 1037 | 1166 | 1295 |
| clonotype 209 | 1 | IGHV3-21 | IGLV3-27 | CAGVLYYDSS GYPFDYW | 909 | CYSAADNNL VF | 1038 | 1167 | 1296 |
| clonotype 210 | 1 | IGHV7-4-1 | IGLV3-1 | CARDPLAARP VGWEDPW | 910 | CQAWDSSTA VF | 1039 | 1168 | 1297 |
| clonotype 211 | 1 | IGHV3-21 | IGLV3-19 | CAREDGYSSG WNYFDYW | 911 | CNSRDSSGN HWVF | 1040 | 1169 | 1298 |
| clonotype 212 | 1 | IGHV1-24 | IGLV3-21 | CATGGQTIVA ARVFDYW | 912 | CQVWDSSSD HVVF | 1041 | 1170 | 1299 |
| clonotype 213 | 1 | IGHV7-4-1 | IGLV3-19 | CARDQTPSDH YYYMDVW | 913 | CNSRDSSGN HYVF | 1042 | 1171 | 1300 |
| clonotype 214 | 1 | IGHV1-2 | IGLV3-19 | CARDRGITMR LDNMDVW | 914 | CNSRDSSGN HLVF | 1043 | 1172 | 1301 |
| clonotype 215 | 1 | IGHV3-73 | IGLV2-23 | CTRRYNWNDV GFDYW | 915 | CCSYAGSNT YVF | 1044 | 1173 | 1302 |
| clonotype 217 | 1 | IGHV2-5 | IGLV3-1 | CAHRPGITGN TGYFDYW | 916 | CQAWDSSTV VF | 1045 | 1174 | 1303 |
| clonotype 218 | 1 | IGHV1-18 | IGLV3-1 | CARCRYSGSL TSYYMDVW | 917 | CQAWDSSTV VF | 1046 | 1175 | 1304 |
| clonotype 219 | 1 | IGHV3-43 | IGLV3-1 | CAKDMITGTT NYYYMDVW | 918 | CQAWDSSTV VF | 1047 | 1176 | 1305 |
| clonotype 220 | 1 | IGHV3-43 | IGLV3-9 | CAKGGYDEWS GYYPFDPW | 919 | CQVWDNNTP WVF | 1048 | 1177 | 1306 |

TABLE 6-continued

H-CDR3 and VL-CDR3 Sequences for Anti-CD131 Antibodies

| clonotype_ id | fre- quency | VH Gene | VL Gene | VH-CDR3 AA | SEQ ID NO | VL-CDR3 AA | SEQ ID NO | Full HC AA Sequence SEQ ID NO | Full LC AA Sequence SEQ ID NO |
|---|---|---|---|---|---|---|---|---|---|
| clonotype 223 | 1 | IGHV3- 15 | IGLV3- 10 | CTTEGTTVTT WAFDIW | 920 | CYSTDSSGN HRVF | 1049 | 1178 | 1307 |
| clonotype 225 | 1 | IGHV6- 1 | IGLV3- 10 | CASSGSYSDA FDIW | 92 | CYSTDSSGN HRVF | 1050 | 1179 | 1308 |
| clonotype 226 | 1 | IGHV7- 4-1 | IGLV1- 44 | CAKDRTGYYH YYYFMDVW | 922 | CAAWDDSLN GWLF | 1051 | 1180 | 1309 |
| clonotype 228 | 1 | IGHV1- 18 | IGLV1- 40 | CARSGYNWKY DYYYMDVW | 923 | CQSYDSSLS GSLVF | 1052 | 1181 | 1310 |
| clonotype 230 | 1 | IGHV3- 7 | IGLV 3-10 | CAREGGYDFW SGLNWFDPW | 924 | CYSTDSSGN HRVF | 1053 | 1182 | 1311 |
| clonotype 232 | 1 | IGHV1- 18 | IGLV3- 10 | CARAGGIAAA GTGYWFDPW | 925 | CYSTDSSGN HRVF | 1054 | 1183 | 1312 |
| clonotype 234 | 1 | IGHV3- 15 | IGLV3- 19 | CTTADYDEWS GYYMDVW | 926 | CNSRDSSGN HWVF | 1055 | 1184 | 1313 |
| clonotype 236 | 1 | IGHV6- 1 | IGLV3- 10 | CARDLELRGG AFDIW | 927 | CYSTDSSGN HRVF | 1056 | 1185 | 1314 |
| clonotype 242 | 1 | IGHV3- 21 | IGLV3- 10 | CTRGEGATWG NYHCYYMDVW | 928 | CYSTDSSGN HRVF | 1057 | 1186 | 1315 |
| clonotype 245 | 1 | IGHV1- 2 | IGLV3- 19 | CARDQITMVR GFLGDWFDPW | 929 | CNSRDSSGN HLVF | 1058 | 1187 | 1316 |
| clonotype 247 | 1 | IGHV4- 39 | IGLV3- 10 | CARGYSYEFD YW | 930 | CYSTDSSGN HRVF | 1059 | 1188 | 1317 |
| clonotype 248 | 1 | IGHV6- 1 | IGLV3- 21 | CAREEIVGAT TAFDIW | 931 | CQVWDSSSD HWVF | 1060 | 1189 | 1318 |
| clonotype 249 | 1 | IGHV6- 1 | IGLV3- 10 | CARDYGGNSG WYFDLW | 932 | CYSTDSSGN HRVF | 1061 | 1190 | 1319 |
| clonotype 251 | 1 | IGHV4- 34 | IGLV2- 14 | CAREGLTGHV FDIW | 933 | CSSYTSSIT WVF | 1062 | 1191 | 1320 |
| clonotype 252 | 1 | IGHV6- 1 | IGLV2- 14 | CARGGGSGSY DWFDPW | 934 | CSSYTSSST WVF | 1063 | 1192 | 1321 |
| clonotype 255 | 1 | IGHV3- 21 | IGLV3- 19 | CAREGVLCSG GSCYREIFDY W | 935 | CNSRDSSGN HLVF | 1064 | 1193 | 1322 |
| clonotype 261 | 1 | IGHV3- 15 | IGLV1- 40 | CSTSPYYDFW SGYYGYIDYW | 936 | CQSFDSSLS GVMF | 1065 | 1194 | 1323 |
| clonotype 262 | 1 | IGHV3- 15 | IGLV1- 40 | CSTSPYFDFW SGYYGYLDYW | 937 | CQSYDSSLS GVVF | 1066 | 1195 | 1324 |
| clonotype 263 | 1 | IGHV4- 39 | IGLV5- 45 | CARHAAAGGW FDPW | 938 | CMIWHSSAV VF | 1067 | 1196 | 1325 |
| clonotype 264 | 1 | IGHV4- 39 | IGLV3- 1 | CARRSSSGIG AFDIW | 939 | CQAWDSSTV VF | 1068 | 1197 | 1326 |
| clonotype 266 | 1 | IGHV4- 34 | IGLV3- 21 | CARGRGIAAR PPYFDYW | 940 | CQVWDSSSD HVVF | 1069 | 1198 | 1327 |
| clonotype 269 | 1 | IGHV4- 39 | IGLV3- 10 | CASEYSSSSL DAFDIW | 941 | CYSTDSSGN HRVF | 1070 | 1199 | 1328 |

TABLE 6-continued

H-CDR3 and VL-CDR3 Sequences for Anti-CD131 Antibodies

| clonotype_ id | fre- quency | VH Gene | VL Gene | VH-CDR3 AA | SEQ ID NO | VL-CDR3 AA | SEQ ID NO | Full HC AA Sequence SEQ ID NO | Full LC AA Sequence SEQ ID NO |
|---|---|---|---|---|---|---|---|---|---|
| clonotype 270 | 1 | IGHV4- 34 | IGLV3- 1 | CARGTTVVTP TEYYYMDVW | 942 | CQAWDSSTV VF | 1071 | 1200 | 1329 |
| clonotype 272 | 1 | IGHV1- 8 | IGLV1- 40 | CARRGDFWSG YYSTSQNIVI HWFDSW | 943 | CQSYDSSLS GSVF | 1072 | 1201 | 1330 |

TABLE 7

Full Heavy Chain (HC) and Light Chain (LC) Sequences for Anti-CD131
Antibodies

| SEQ ID NO | Full HC AA Sequence | SEQ ID NO | Full LC AA Sequence |
|---|---|---|---|
| 1073 | QLQLQESGPGLVKPSETLSLTCTVSGGSISSS SYYWGWIRQPPGKGLEWIGSIYYSGSTYYNPS LKSRVTISVDTSKNQFSLKLSSVTAADTAVYY CASLTGDRFDYWGQGTLVTVSS | 1202 | QSALTQPASVSGSPGQSITISCTGTSSDV GGYNYVSWYQQHPGKAPKLMIYEVSNRPS GVSNRFSGSKSGNTASLTISGLQAEDEAD YYCSSYTSSSTVVFGGGTKLTVL |
| 1074 | EVQLVESGGGLVKPGGSLRLSCAASGFTFSNA WMSWVRQAPGKGLEWVGRIKSKTDGGTTDYAA PVKGRFTISRDDSKNTLYLQMNSLKTEDTAVY YCTGRPSIAARHFDYWGQGTLVTVSS | 1203 | SYELTQPPSVSVSPGQTARITCSGDALPK KYAYWYQQKSGQAPVLVIYEDSKRPSGIP ERFSGSSSGTMATLTISGAQVEDEADYYC YSTDSSGNHSVFGTGTKVTVL |
| 1075 | EVQLVESGGGVVRPGGSLRLSCAASGFTFDDY GMSWVRQAPGKGLEWVSGINWNGGSTGYADSV KGRFTISRDNAKNSLYLQMNSLRAEDTALYYC ARERLTIFGVVNYYMDVWGKGTTVTVSS | 1204 | QSVLTQPPSVSGAPGQRVTISCTGSSSNI GAGYDVHWYQQLPGTAPKLLIYGNSNRPS GVPDRFSGSKSGTSASLAITGLQAEDEAD YYCQSYDSSLSGWVFGGGTKLTVL |
| 1076 | EVQLVESGGGLVQPGGSLRLSCAASGFTFSSY SMNWVRQAPGKGLEWVSYISSSSSTIYYADSV KGRFTISRDNAKNSLYLQMNSLRDEDTAVYYC ARDGWDYWGQGTLVTVSS | 1205 | SYELTQPSSVSVSPGQTARITCSGDVLAK KYARWFQQKPGQAPVLVIYKDSERPSGIP ERFSGSSSGTTVTLTISGAQVEDEADYYC YSAADNNRVFGGGTKLTVL |
| 1077 | EVQLVESGGGLVQPGGSLKLSCAASGFTFSSS DMHWVRQTTGKGLEWVSAIYTTGDTYYPGSVK GRFTISRENAKNSLYLQMNSLRAGDTAVYYCA RGYSGSYYGDFDYWGQGTLVTVSS | 1206 | SYELTQPPSVSVSPGQTARITCSGDALPK KYAYWYQQKSGQAPVLVIYEDSKRPSGIP ERFSGSSSGTMATLTISGAQVEDEADYYC YSTDSSGNRVFGGGTKLTVL |
| 1078 | EVQLVESGGGLVQPGGSLRLSCAASGFTFSSY AMSWVRQAPGKGLEWVSAISGSGGSTYYADSV KGRFTISRDNSKNTLYLQMNSLRAEDTAVYYC AKKPPRDSAFDYWGQGTLVTVSS | 1207 | QSVLTQPPSVSGAPGQRVTISCTGSSSNI GAGYDVHWYQQLPGTAPKLLIYGNSNRPS GVPDRFSGSKSGTSASLAITGLQAEDEAD YYCQSYDSSLSGSVFGGGTKLTVL |
| 1079 | QVQLVQSGAEVKKPGASVKVSCKASGYTFTSY GISWVRQAPGQGLEWMGWISAYNGNTNYAQKL QGRVTMTTDTSTSTAYMELRSLRSDDTAVYYC ARENSGSYYWFDPWGQGTLVTVSS | 1208 | QSALTQPPSASGSPGQSVTISCTGTSSDV GGYNYVSWYQQHPGKAPKLMIYEVSKRPS GVPDRFSGSKSGNTASLTVSGLQAEDEAD YYCSSYAGSNNVVFGGGTKLTVL |
| 1080 | EVQLVESGGGLVQPGGSLRLSCAASGFTFSSY AMSWVRQAPGKGLEWVSAISGSGGSTYYADSV KGRFTISRDNSKNTLYLQMNSLRAEDTAVYYC AKLEYSSPDYWGQGTLVTVSS | 1209 | QSALTQPASVSGSPGQSITISCTGTSSDV GGYNYVSWYQQHPGKAPKLMIYDVSKRPS GVSNRFSGSKSGNTASLTISGLQAEDEAD YYCCSYAGSSTLVFGGGTKLTVL |
| 1081 | QVQLQQWGAGLLKPSETLSLTCAVYGGSFSGY YWSWIRQPPGKGLEWIGEINHSGSTNYNPSLK SRVTISVDTSKNQFSLKLSSVTAADTAVYYCA REGLLVGATLDAFDIWGQGTMVTVSS | 1210 | SSELTQDPAVSVALGQTVRITCQGDSLRS YYASWYQQKPGQAPVLVIYGKNNRPSGIP DRFSGSSSGNTASLTITGAQAEDEADYYC NSRDSSGNHLVFGTGTKVTVL |
| 1082 | QVQLVESGGGVVQPGRSLRLSCAASGFTFSSY GMHWVRQAPGKGLEWVAVIWYDGSNKYYADSV KGRFTISRDNSKNTLYLQMNSLRAEDTAVYYC ARDTGITMVRGVFDYWGQGTLVTVSS | 1211 | SYVLTQPPSVSVAPGKTARITCGGNNIGS KSVHWYQQKPGQAPVLVIYYDSDRPSGIP ERFSGSNSGNTATLTISRVEAGDEADYYC QVWDSSSDHPVFGGGTKLTVL |
| 1083 | QVQLVQSGAEVKKPGASVKVSCKASGYTFTSY GISWVRQAPGQGLEWMGWISAYNGNTNYAQKF QGRVTMTTDTSTNTAYMELRSLRSDDKAVFYC ARDRTGISAAGPSNWFDPWGQGTLVTVSS | 1212 | QSVLTQPPSASGTPGQRVTISCSGSSSNI GSNTVNWYQQLPGTAPKLLIYSNNQRPSG VPDRFSGSKSGTSASLAISGLQSEDEADY YCAAWDDSLNGPVFGGGTKLTVL |

TABLE 7-continued

Full Heavy Chain (HC) and Light Chain (LC) Sequences for Anti-CD131
Antibodies

| SEQ ID NO | Full HC AA Sequence | SEQ ID NO | Full LC AA Sequence |
|---|---|---|---|
| 1084 | QVQLQQWGAGLLKPSETLSLTCAVYGGSFSGY YWSWIRQPPGKGLEWIGEINHSGSTNYNPSLK SRVTISVDTSKNQFSLKLSSVTAADTAVYYCA RTSLAAADFDYWGQGTLVTVSS | 1213 | QSALTQPPSASGSPGQSVTISCTGTSSDV GGYNYVSWYQQHPGKAPKLMIYEVSKRPS GVPDRFSGSKSGNTASLTVSGLQAEDEAD YYCSSYAGSNNYVFGTGTKVTVL |
| 1085 | EVQLVESGGGLIQPGGSLRLSCAASGFTVSSN YMSWVRQAPGKGLEWVSVIYSGGSTYYADSVK GRFTISRDNSKNTLYLQMNSLRAEDTAVYYCA RAPDYYGSGSLFDYWGQGTLVTVSS | 1214 | QSVLTQPPSVSEAPRQRVTISCSGSSSNI GNNAVNWYQQLPGKAPKLLIYYDDLLPSG VSDRFSGSKSGTSASLAISGLQSEDEADY YCAAWDDRLNGPVFGGGTKLTVL |
| 1086 | EVQLVESGGGLVKPGGSLRLSCIASGFTFSTY SMNWVRQAPGKGLEWVSSISGSSSYIYYSDSV KGRFTISRDNAKNSLYLQLNSLRAEDTAVYYC ASHWGHFDYWGRGTLVTVSS | 1215 | SYELTQPLSVSVALGQTARITCGGNNIGS KNVHWYQQKPGQAPVLVIYRDSNRPSGIP ERFSGSNSGNTATLTISRAQAGDEADYYC QVWDSSTVVFGGGTKLTVL |
| 1087 | EVQLVESGGGLVQPGGSLRLSCAASGFTFSSY DMHWVRQATGKGLEWVSAIGTAGDTYYPGSVK GRFTISRENAKNSLYLQMNSLRAGDTAVYYCA RDRTLDYWGQGTLVTVSS | 1216 | SYELTQPPSVSVSPGQTARITCSGDALPK KYAYWYQQKSGQAPVLVIYEDSKRPSGIP ERFSGSSSGTMATLTISGAQVEDEADYYC YSTDSSGNHWVFGGGTKLTVL |
| 1088 | QVQLVQSGAEAKKPGASVKVSCMASGYTFTTY GISWVRQAPGQGLEWMGWISAYNGNTKYAQKL QGRVTMTTDTSTRTAYMELRSLRSDDTAVYYC ARQIGDYWGQGTLVTVSS | 1217 | QSALTQPPSASGSPGQSVTISCTGTSSDV GGYNYVSWYQQHPGKAPKLMIYEVIKRPS GVPDRFSGSKSGNTASLTVSGLQAEDEAD YYCSAYAGSNNVVFGGGTQLTVL |
| 1089 | EVQLVESGGGLVQTGGSLKLSCAASGFTFSVS PIHWVRQASGKGLEWVGRIRSKANSYATAYGA SVKGRFTISRDDSKNTAYLQMNSLKTEDTAVY YCTGPFDNWGQGTLVTVSS | 1218 | SYELTQPPSVSVSPGQTASITCSGDKLGD KYACWYQQKPGQSPVLVIYQDSKRPSGIP ERFSGSNSGNTATLTISGTQAMDEADYYC QAWDSSTGVFGGGTKLTVL |
| 1090 | EVQLVESGGGLVKPGGSLRLSCAASGFTFSNA WMSWVRQAPGKGLEWVGRIKSKTDGGTTDYTA PVKGRFTISRDDSKNTLYLQMNSLRTEDTAVY YCTTGGHYWGQGTLVTVSS | 1219 | SYELTQPPSVSVSPGQTARITCSADALPN QYAYWYQQKPGQAPVLVIYKDSERPSGIP ERFSGSSSGTTVTLTISGVQAEDEADYYC QSADSSGTWVFGGGTKLTVL |
| 1091 | EVQLVESGGGLVQPGRSLRLSCAASGFTFDDY AMHWVRQAPGKGLEWVSGISWNSGSIGYADSV KGRFTISRDNAKNSLYLQMNSLRAEDTALYYC AKARSFDIWGQGTMVTVSS | 1220 | SYELTQPPSVSVSPGQTARITCSGDALPK KYAYWYQQKSGQAPVLVIYEDSKRPSGIP ERFSGSSSGTMATLTISGAQVEDEADYYC YSTDSSGNHRVFGGGTKLTVL |
| 1092 | EVQLVESGGGLVKPGGSLRLSCAASGFTFSDA WMYWDRQAPGKGLEWVGRIKSKTDGGTTDYAA PVKGRFTISRDDSKNTLYLQMNSLKTEDTAVY YCRADMDVWGKGTTVTVSS | 1221 | SYELTQPPSVSVSPGQTARITCSGDALPK KYAYWYQQKSGQAPVLVIYEDSKRPSGIP ERFSGSSSGTMATLTISGAQVEDEADYYC YSIDSSGNHRVFGGGTKLTVL |
| 1093 | EVQLVESGGGVVRPGGSLRLSCAASGFTFDDY GMSWVRQAPGKGLEWVSGINWNGGSTGYADSV KGRFTISRDNAKNSLYLQMNSLRAEDTALYYC ARDRGFDYWGQGTLVTVSS | 1222 | SYELTQPPSVSVSPGQTARITCSGDALPK KYAYWYQQKSGQAPVLVIYEDSKRPSGIP ERFSGSSSGTMATLTISGAQVEDEADYYC YSTDSSGNHRVFGGGTKLTVL |
| 1094 | EVQLVESGGGLIQPGGSLRLSCAASGFTVSSN YMSWVRQAPGKGLEWVSVIYSGGSTYYADSVK GRFTISRDNSKNTLYLQMNSLRAEDTAVYYCA RGGDYFDYWGQGTLVTVSS | 1223 | SYELTQPPSVSVSPGQTARITCSGDALPK KYAYWYQQKSGQAPVLVIYEDSKRPSGIP ERFSGSSSGTMATLTISGAQVEDEADYYC YSTDSSGNHRVFGGGTKLTVL |
| 1095 | QVQLVQSGAEVKKPGASVKVSCKTSGYTFTSF GISWVRQAPGQGLEWMGWISAYNDNINYAQKL QDRVTMTTDTSTSTACMELRSLRSDDTAVYFC ARGASFDFWGQGTLVTVSS | 1224 | QSALTQPASVSGSPGQSITISCTGTSSDV GGYNYVSWYQQHPGKAPKLMIYEVSDRPS GVSNRFSGSKSGNTASLTISGLQAEDEAD YYCSSYTRSSTCVFGGGTKLTVL |
| 1096 | EVQLVESGGGLVQPGGSLKLSCAASGFTFSGS AMHWVRQASGKGLEWVGRIRSKANSYATAYAA SVKGRFTISRDDSKNTAYLQMNSLKTEDTAVY YCTGPFDYWGQGTLVTVSS | 1225 | QSALTQPASVSGSPGQSITISCTGTSSDV GGYNYVSWYQQHPGKAPKLMIYEVSNRPS GVSNRFSGSKSGNTASLTISGLQAEDEAD YYCSSYTSSSTWVFGGGTKLTVL |
| 1097 | EVQLVESGGGLIQPGGSLRLSCAASGFTVSSN YMSWVRQAPGKGLEWVSVIYSGGSTYYADSVK GRFTISRDNSKNTLYLQMNSLRAEDTAVYYCA RSFDAFDIWGQGTMVTVSS | 1226 | QSALTQPASVSGSPGQSITISCTGTSSDV GGYNYVSWYQQHPGKAPKLMIYDVSKRPS GVSNRFSGSKSGNTASLTISGLQAEDEAD YYCCSYAGSSTFVVFGGGTKLTVL |

TABLE 7-continued

Full Heavy Chain (HC) and Light Chain (LC) Sequences for Anti-CD131
Antibodies

| SEQ ID NO | Full HC AA Sequence | SEQ ID NO | Full LC AA Sequence |
|---|---|---|---|
| 1098 | EVQLVESGGGLVKPGGSLRLSCAASGFTFSSY SMNWVRQAPGKGLEWVSSISSSSSYIYYADSV KGRFTISRDNAKNSLYLQMNSLRAEDTAVYYC AGLTGELDYWGQGTLVTVSS | 1227 | SYELTQPSSVSVSPGQTARITCSGDVLAK KYARWFQQKPGQAPVLVIYKDSERPSGIP ERFSGSSSGTTVTLTISGAQVEDEADYYC YSAADNNLVFGGGTKLTVL |
| 1099 | EVQLVESGGGLVQPGGSLRLSCAASGFTFSSY DMHWVRQATGKGLEWVSAIGTAGDTYYPGSVK GRFTISRENAKNSLYLQMNSLRAGDTAVYYCA RWGTGGFDYWGQGTLVTVSS | 1228 | SYELTQPPSVSVSPGQTARITCSADALPK QYAYWYQQKPGQAPVLVIYKDSERPSGIP ERFSGSSSGTTVTLTISGVQAEDEADYYC QSADSSGTWVFGGGTKLTVL |
| 1100 | EVQLVESGGGLVKPGGSLRLSCAASGFTFSSY SMNWVRQAPGKGLEWVSSISSSSSYIYYADSV KGRFTISRDNAKNSLYLQMNSLRAEDTAVYYC ARREGFFDYWGQGTLVTVSS | 1229 | SYELTQPPSVSVSPGQTARITCSGDALPK KYAYWYQQKSGQAPVLVIYEDSKRPSGIP ERFSGSSSGTMATLTISGAQVEDEADYYC YSTDSSGNHRVFGGGTKLTVL |
| 1101 | EVQLVESGGGLVQPGGSLRLSCAASGFTFSSY WMSWVRQAPGKGLEWVANIKQDGSEKYYVDSV KGRFTISRDNAKNSLYLQMNSLRAEDTAVYYC ARDQLAPDYWGQGTLVTVSS | 1230 | SYELTQPPSVSVSPGQTARITCSGDALPK KYAYWYQQKSGQAPVLVIYEDSKRPSGIP ERFSGSSSGTMATLTISGAQVEDEADYYC YSTDSSGNHRVFGGGTKLTVL |
| 1102 | EVQLVESGGGLVQPGGSLRLSCAASGFTFSSY AMSWVRQAPGKGLEWVSAISGSGGSTYYADSV KGRFTISRDNSKNTLYLQMNSLRAEDTAVYYC AKDSSGFDYWGQGTLVTVSS | 1231 | SYELTQPPSVSVSPGQTARITCSGDALPK KYAYWYQQKSGQAPVLVIYEDSKRPSGIP ERFSGSSSGTMATLTISGAQVEDEADYYC YSTDSSGNHRVFGGGTKLTVL |
| 1103 | EVQLVESGGGLVQPGGSLRLSCAASGFTFSSY AMSWVRQAPGKGLEWVSAISGSGGSTYYADSV KGRFTISRDNSKNTLYLQMNSLRAEDTAVYYC AKDPQFFDYWGQGTLVTVSS | 1232 | SYELTQPPSVSVSPGQTARITCSGDALPK KYAYWYQQKSGQAPVLVIYEDSKRPSGIP ERFSGSSSGTMATLTISGAQVEDEADYYC YSTDSSGNHRVFGGGTKLTVL |
| 1104 | EVQLVESGGGLVQPGGSLRLSCAASGFTFSSY AMSWVRQAPGKGLEWVSAISGSGGSTYYADSV KGRFTISRDNSKNTLYLQMNSLRAEDTAVYYC AKDGTAFDIWGQGTMVTVSS | 1233 | SYELTQPPSVSVSPGQTARITCSGDALPK KYAYWYQQKSGQAPVLVIYEDSKRPSGIP ERFSGSSSGTMATLTISGAQVEDEADYYC YSTDSSGNHRVFGGGTKLTVL |
| 1105 | QVQLVESGGGVVQPGRSLRLSCAASGFTFSSY GMHWVRQAPGKGLEWVAVIWYDGSNKYYADSV KGRFTISRDNSKNTLYLQMNSLRAEDTAVYYC ARDRGWGLDYWGQGTLVTVSS | 1234 | SYELTQPLSVSVALGQTARITCGGNNIGS KNVHWYQQKPGQAPVLVIYRDSNRPSGIP ERFSGSNSGNTATLTISRAQAGDEADYYC QVWDSSTGVFGGGTKLTVL |
| 1106 | QVQLVESGGGVVQPGRSLRLSCAASGFPFSNS GMHWVRQAPGKGLEWVTIISYDGNSKYYADSV KGRFTISRDNSKNTLYLQMNSLRTEDTAVYYC ARGELGDFDYWGRGTLVTVSS | 1235 | SSELTQDPAVSVALGQTVRITCQGDSLRS YYASWYQQKPGQAPVLVIYGKNNRPSGIP DRFSGSSSGNTASLTITGAQAEDEADYYC NSRDSSGNHLVFGGGTKLTVL |
| 1107 | QVQLVQSGAEVKKPGASVKVSCKASGYTFTGY YMHWVRQAPGQGLEWMGWINPNSGGTNYAQKF QGRVTMTRDTSISTAYMELSRLRSDDTAVYYC ARVLELYFDYWGQGTLVTVSS | 1236 | QTVVTQEPSLTVSPGGTVTLTCASSTGAV TSGYYPNWFQQKPGQAPRALIYSTSNKHS WTPARFSGSLLGGKAALTLSGVQPEDEAE YYCLLYYGGAVVFGGGTKLTVL |
| 1108 | EVQLVESGGGLVKPGGSLRLSCAASGFTFSNA WMSWVRQAPGKGLEWVGRIKSKTDGGTTDYAA PVKGRFTISRDDSKNTLYLQMNSLKTEDTAVY YCTTRSDFQHWGQGTLVTVSS | 1237 | QSVLTQPPSASGTPGQRVTISCSGSSSNI GSNTVNWYQQLPGTAPKLLIYSNNQRPSG VPDRFSGSKSGTSASLAISGLQSEDEADY YCAAWDDSLNGWVFGGGTKLTVL |
| 1109 | QVQLVQSGAEVKKPGASVKVSCKASGYTFTSY DINWVRQATGQGLEWMGWMNPNSGNTGYAQKF QGRVTMTRNTSISTAYMELSSLRSEDTAVYYC ARDQELRVFDYWGQGTLVTVSS | 1238 | SYELTQPPSVSVSPGQTASITCSGDKLGD KYACWYQQKPGQSPVLVIYQDSKRPSGIP ERFSGSNSGNTATLTISGTQAMDEADYYC QAWDSSTVVFGGGTKLTVL |
| 1110 | QVQLVESGGGVVQPGRSLRLSCAASGFTFSSY GMHWVRQAPGKGLEWVAVISYDGSNKYYADSV KGRFTISRDNSKNTLYLQMNSLRAEDTAVYYC AKASGYGPFDYWGQGTLVTVSS | 1239 | SYELTQPPSVSVSPGQTASITCSGDKLGD KYACWYQQKPGQSPVLVIYQDSKRPSGIP ERFSGSNSGNTATLTISGTQAMDEADYYC QAWDSSTVVFGGGTKLTVL |
| 1111 | EVQLVQSGAEVKKPGESLKISCKGSGYSFTSY WIGWVRQMPGKGLEWMGIIYPGDSDTRYSPSF QGQVTISADKSISTAYLQWSSLKASDTAMYYC ARHSSSSHFDYWGQGTLVTVSS | 1240 | SYELTQPPSVSVSPGQTASITCSGDKLGD KYACWYQQKPGQSPVLVIYQDSKRPSGIP ERFSGSNSGNTATLTISGTQAMDEADYYC QAWDSSTVVFGGGTKLTVL |
| 1112 | EVQLVESGGGLVKPGGSLRLSCAASGFTFSSY SMNWVRQAPGKGLEWVSSISSSSSYIYYADSV KGRFTISRDNAKNSLYLQMNSLRAEDTAVYYC ARDRGNSLFDYWGQGTLVTVSS | 1241 | SYELTQPPSVSVSPGQTARITCSGDALPK KYAYWYQQKSGQAPVLVIYEDSKRPSGIP ERFSGSSSGTMATLTISGAQVEDEADYYC YSTDSSGNHRVFGGGTKLTVL |

TABLE 7-continued

Full Heavy Chain (HC) and Light Chain (LC) Sequences for Anti-CD131
Antibodies

| SEQ ID NO | Full HC AA Sequence | SEQ ID NO | Full LC AA Sequence |
|---|---|---|---|
| 1113 | QVQLVQSGAEVKKPGASVKVSCKASGYTFTGY YMHWVRQAPGQGLEWMGWINPNSGGTNYAQKF QGRVTMTRDTSISTAYMELSRLRSDDTAVYYC ARDKSLEWFDYWGQGTLVTVSS | 1242 | SYELTQPPSVSVSPGQTARITCSGDALPK KYAYWYQQKSGQAPVLVIYEDSKRPSGIP ERFSGSSSGTMATLTISGAQVEDEADYYC YSTDSSGNHRVFGGGTKLTVL |
| 1114 | EVQLVESGGGLVQPGGSLRLSCAASGFTFSSY DMHWVRQATGKGLEWVSAIGTAGDTYYPGSVK GRFTISRENAKNSLYLQMNSLRAGDTAVYYCA RGDWNYGGFDYWGQGTLVTVSS | 1243 | SYELTQPPSVSVSPGQTARITCSGDALPK KYAYWYQQKSGQAPVLVIYEDSKRPSGIP ERFSGSSSGTMATLTISGAQVEDEADYYC YSTDSSGNHRVFGGGTKLTVL |
| 1115 | EVQLVESGGGLVKPGGSLRLSCAASGFTFSNA WMSWVRQAPGKGLEWVGRIKSKTDGGTTDYAA PVKGRFTISRDDSKNTLYLQMNSLKTEDTAVY YCTTAPDAFDIWGQGTMVTVSS | 1244 | SYELTQPPSVSVSPGQTARITCSGDALPK KYAYWYQQKSGQAPVLVIYEDSKRPSGIP ERFSGSSSGTMATLTISGAQVEDEADYYC YSTDSSGNHRVFGGGTKLTVL |
| 1116 | EVQLVESGGGLVQPGGSLRLSCAASGFTFSSY AMSWVRQAPGKGLEWVSAISGSGGSTYYADSV KGRFTISRDNSKNTLYLQMNSLRAEDTAVYYC ASGITGTTGDYWGQGTLVTVSS | 1245 | SYELTQPPSVSVSPGQTARITCSGDALPK KYAYWYQQKSGQAPVLVIYEDSKRPSGIP ERFSGSSSGTMATLTISGAQVEDEADYYC YSTDSSGNHRVFGGGTKLTVL |
| 1117 | EVQLVESGGGLVQPGGSLRLSCAASGFTFSSY AMSWVRQAPGKGLEWVSAISGSGGSTYYADSV KGRFTISRDNSKNTLYLQMNSLRAEDTAVYYC AKEGAHDAFDIWGQGTMVTVSS | 1246 | SYELTQPPSVSVSPGQTARITCSGDALPK KYAYWYQQKSGQAPVLVIYEDSKRPSGIP ERFSGSSSGTMATLTISGAQVEDEADYYC YSTDSSGNHRVFGGGTKLTVL |
| 1118 | EVQLVESGGGLVQPGGSLRLSCAASGFTFSSY AMSWVRQAPGKGLEWVSAISGSGGSTYYADSV KGRFTISRDNSKNTLYLQMNSLRAEDTAVYYC AKDKGELPFDYWGQGTLVTVSS | 1247 | SYELTQPPSVSVSPGQTARITCSGDALPK KYAYWYQQKSGQAPVLVIYEDSKRPSGIP ERFSGSSSGTMATLTISGAQVEDEADYYC YSTDSSGNHRVFGGGTKLTVL |
| 1119 | QVQLVESGGGVVQPGRSLRLSCAASGFTFSSY GMHWVRQAPGKGLEWVAVIWYDGSNKYYADSV KGRFTISRDNSKNTLYLQMNSLRAEDTAVYYC AKLGVRDYMDVWGKGTTVTVSS | 1248 | SSELTQDPAVSVALGQTVRITCQGDSLRS YYASWYQQKPGQAPVLVIYGKNNRPSGIP DRFSGSSSGNTASLTITGAQAEDEADYYC NSRDSSGNHWVFGGGTKLTVL |
| 1120 | EVQLVESGGGVVRPGGSLRLSCAASGFTFDDY GMSWVRQAPGKGLEWVSGINWNGGSTGYADSV KGRFTISRDNAKNSLYLQMNSLRAEDTALYYC AREGGGWVFDYWGQGTLVTVSS | 1249 | SSELTQDPAVSVALGQTVRITCQGDSLRS YYASWYQQKPGQAPVLVIYGKNNRPSGIP DRFSGSSSGNTASLTITGAQAEDEADYYC NSRDSSGNHWVFGGGTKLTVL |
| 1121 | EVQLVQSGAEVKKPGESLKISCKGSGYSFTSY WIGWVRQMPGKGLEWMGIIYPGDSDTRYSPSF QGQVTISADKSISTAYLQWSSLKASDTAMYYC ARGGGGDPFDYWGQGTLVTVSS | 1250 | SYELTQPPSVSVSPGQTARITCSGDALPK KYAYWYQQKSGQAPVLVIYEDSKRPSGIP ERFSGSSSGTMATLTISGAQVEDEADYYC YSTDSSGNHRVFGGGTKLTVL |
| 1122 | QVQLVQSGAEVKKPGASVQVSCKASGYTFTGY YIHWVRQAPGQGLEWMGWINPNSGGTNYAQKF QGRVIMTRDTSISIAYIELSRLRSDDTAVYYC ARPYNWNSFDYWGQGTLVTVSS | 1251 | QSALTQPASVSGSLGQSITISCTGTSSDV GGYNYVSWYQHHPGKAPKIMIYDVSNRPS GVSNRFSASKSGNTASLTISGLQTEDEAD YYCSSYTTSSTWVFGGGTNLTVL |
| 1123 | EVQLVESGGDLVQPGRSLRLSCAASGFTFDDH AIHWVRQAPGKGLEWVSGVTWNSNIIGYADSV KGRFTISRDIAKNSLYLQMNSLRPEDTALYYC AKDNDWNGFDYWGQGTLVTVSS | 1252 | QSALTQPASVSGSPGQSITISCTGTSSDV GGYNYVSWYQQHPGKAPKLMIYEVSNRPS VISYRFSGSKSGNTASLTISGLQAEDEAD YYCNSYTTNTTRVFGGGTKLTVL |
| 1124 | EVQLVESGGGLVQPGRSLRLSCAASGFTFDDY AMHWVRQAPGKGLEWVSGISWNSGSIGYADSV KGRFTISRDNAKNSLYLQMNSLRAEDTALYYC AKDNWNYAFDIWGQGTMVTVSS | 1253 | QSALTQPASVSGSPGQSITISCTGTSSDV GGYNYVSWYQQHPGKAPKLMIYEVSNRPS GVSNRFSGSKSGNTASLTISGLQAEDEAD YYCSSYTSSSTRVFGGGTKLTVL |
| 1125 | EVQLVESGGGLVQPGGSLRLSCTASGFTFSSY WMHWVRQAPGKGLVWVSRVNSDGGNTIYADSV KGRFTISRDNAKNTLYLQMNSLRAEDTAIYYC ARDLDWTLFDYWGQGTLVTVSS | 1254 | QAVLTQPASLSASPGASASLTCTLRSGIY VGTYRIYWYQQKPGSPPQYLLRYKSDSDK QQGSGVPSRFSGSKDVSANAGILLISGLQ SEDEADYYCMTWHSSAVVFGGGTKLTVL |
| 1126 | EVQLVESGGGLVQPGGSLRLSCAASGFTFSSY WMSWVRQAPGKGLEWVANIKQDGSEKYYVDSV KGRFTISRDNAKNSLYLQMNSLRAEDTAVYYC AGDYSNYGWFDPWGQGTLVTVSS | 1255 | SYELTQPPSVSVSPGQTASITCSGDKLGD KYACWYQQKPGQSPVLVIYQDSKRPSGIP ERFSGSNSGNTATLTISGTQAMDEADYYC QAWDSSTVFGGGTKLTVL |
| 1127 | QVQLVQSGAEVKKPGASVKVSCKASGYTFTSY DINWVRQATGQGLEWMGWMNPNSGNTGYAQKF QGRVTMTRNTSISTAYMELSSLRSEDTAVYYC ARARDSGYYMDVWGKGTTVTVSS | 1256 | SYELTQPPSVSVSPGQTASITCSGDKLGD KYACWYQQKPGQSPVLVIYQDSKRPSGIP ERFSGSNSGNTATLTISGTQAMDEADYYC QAWDSSTVVFGGGTKLTVL |

TABLE 7-continued

Full Heavy Chain (HC) and Light Chain (LC) Sequences for Anti-CD131
Antibodies

| SEQ ID NO | Full HC AA Sequence | SEQ ID NO | Full LC AA Sequence |
|---|---|---|---|
| 1128 | QVQLVESGGGVVQPGRSLRLSCAASGFTFSSY GMHWVRQAPGKGLEWVAVIWYDGSNKYYADSV KGRFTISRDNSKNTLYLQMNSLRAEDTAVYYC ARATAMVTGIDYWGQGTLVTVSS | 1257 | SYELTQPSSVSVSPGQTARITCSGDVLAK KYARWFQQKPGQAPVLVIYKDSERPSGIP ERFSGSSSGTTVTLTISGAQVEDEADYYC YSAADNNWVFGGGTKLTVL |
| 1129 | EVQLVESGGGLVQPGGSLKLSCAASGFTFSGS AMHWVRQASGKGLEWVGRIRSKANSYATAYAA SVKGRFTISRDDSKNTAYLQMNSLKTEDTAVY YCTGSSGSYFDYWGQGTLVTVSS | 1258 | SYELTQPSSVSVSPGQTARITCSGDVLAK KYARWFQQKPGQAPVLVIYKDSERPSGIP ERFSGSSSGTTVTLTISGAQVEDEADYYC YSAADNNLVFGGGTKLTVL |
| 1130 | EVQLVESGGGLVKPGGSLRLSCAASGFTFSSY SMNWVRQAPGKGLEWVSSISSSSSYIYYADSV KGRFTISRDNAKNSLYLQMNSLRAEDTAVYYC ARSPYNWNYVDYWGQGTLVTVSS | 1259 | SYELTQPPSVSVSPGQTARITCSGDALPK KYAYWYQQKSGQAPVLVIYEDSKRPSGIP ERFSGSSSGTMATLTISGAQVEDEADYYC YSTDSSGNHRVFGGGTKLTVL |
| 1131 | QVQLVQSGAEVKKPGASVKVSCKVSGYTLTEL SMHWVRQAPGKGLEWMGGFDPEDGETIYAQKF QGRVTMTEDTSTDTAYMDLSSLRSEDTAVYYC ATEGPSTFSFDYWGQGTLVTVSS | 1260 | SYELTQPPSVSVSPGQTARITCSGDALPK KYAYWYQQKSGQAPVLVIYEDSKRPSGIP ERFSGSSSGTMATLTISGAQVEDEADYYC YSTDSSGNHRVFGGGTKLTVL |
| 1132 | QVQLVQSGAEVKKPGASVKVSCKVSGYTLTEL SMHWVRQAPGKGLEWMGGFDPEDGETIYAQKF QGRVTMTEDTSTDTAYMDLSSLRSEDTAVYYC ATANWNDEAFDIWGQGTMVTVSS | 1261 | SSELTQDPAVSVALGQTVRITCQGDSLRS YYASWYQQKPGQAPVLVIYGKNNRPSGIP DRFSGSSSGNTASLTITGAQAEDEADYYC NSRDSSGNHLVFGGGTKLTVL |
| 1133 | EVQLVESGGGLVQPGGSLRLSCAASGFTFSSY SMNWVRQAPGKGLEWVSYISSSSSTIYYADSV KGRFTISRDNAKNSLYLQMNSLRDEDTAVYYC ARDELTGDAFDIWGQGTMVTVSS | 1262 | SYELTQPPSVSVSPGQTARITCSGDALPK KYAYWYQQKSGQAPVLVIYEDSKRPSGIP ERFSGSSSGTMATLTISGAQVEDEADYYC YSTDSSGNHRVFGGGTKLTVL |
| 1134 | EVQLVESGGGLVKPGGSLRLSCAASGFTFSNA WMSWVRQAPGKGLEWVGRIKSKTDGGTTDYAA PVKGRFTISRDDSKNTLYLQMNSLKTEDTAVY YCTTEALGIFDYWGQGTLVTVSS | 1263 | SYELTQPPSVSVSPGQTARITCSGDALPK KYAYWYQQKSGQAPVLVIYEDSKRPSGIP ERFSGSSSGTMATLTISGAQVEDEADYYC YSTDSSGNHRVFGGGTKLTVL |
| 1135 | EVQLVESGGGLVQPGGSLRLSCAASGFTFSSY SMNWVRQAPGKGLEWVSSISSSSSYIYYADSV KGRFTISRDNAKNSLYLQMNSLRAEDTAVYYC ARDGSSGFLFDYWGQGTLVTVSS | 1264 | QTVVTQEPSLTVSPGGTVTLTCASSTGAV TSGYYPNWFQQKPGQAPRALIYSTSNKHS WTPARFSGSLLGGKAALTLSGVQPEDEAE YYCLLYYGGAWVFGGGTKLTVL |
| 1136 | EVQLVESGGGLVQPGGSLRLSCAASGFTFSSY AMSWVRQAPGKGLEWVSAISGSGGSTYYADSV KGRFTISRDNSKNTLYLQMNSLRAEDTAVYYC AKHYYDSRSFDYWGQGTLVTVSS | 1265 | QSALTQPPSASGSPGQSVTISCTGTSSDV GGYNYVSWYQQHPGKAPKLMIYEVSKRPS GVPDRFSGSKSGNTASLTVSGLQAEDEAD YYCSSYAGSNNLVFGGGTKLTVL |
| 1137 | QVQLQESGPGLVKPSGTLSLTCAVSGGSISSS DWWTWVRQPPGRGLEWIGEINHSGTTNYNPSL KSRVTISVDKSKNQFSLKLSSVTAADTAVYYC ARDFQGTGPFDYWGQGTLVTVSS | 1266 | QSALTQPPSVSGAPGQRVTISCTGSSSNI GAGYDVHWFQQLPGTAPKLLIYDNNNRPS GVPNRFSGSKSGTSASLAITGLQADFEAD YYCQSYDGSLNGWVFGGGTKLTVL |
| 1138 | QVQLQQWGAGLLKPSETLSLTCAVFGGSFSGY YWSWIRQPPGKGLEWIGEINHSGSTNYNPSLK SRVTISVDTSKNQFSLKLTSVTAADTTVYYCA RGRLYSGSFSFDYWGQGTLVTVSS | 1267 | SSELTQDPAVSVALGQTVRITCQGDSLRN YYASWYQQKPGQAPVLVIYGKNNRPSGIP DRFSGSSSGNIASLTITGAQAEDEADYYC KSRDRSGNHWVFGGGTKVTVL |
| 1139 | EVQLVESGGGLVQPGGSLRLSCAASGFTFSSY WMSWVRQAPGKGLEWVANIKQDGSEKYYVDSV KGRFTISRDNAKNSLYLQMNSLRAEDTAVYYC ARDGGYNWNFFDYWGQGTLVTVSS | 1268 | SSELTQDPAVSVALGQTVRITCQGDSLRS YYASWYQQKPGQAPVLVIYGKNNRPSGIP DRFSGSSSGNTASLTITGAQAEDEADYYC NSRDSSGNHVVFGGGTKLTVL |
| 1140 | QITLKESGPMLVKPTQTLTLTCTFSGFSLSTS GVGVGWIRQPPGKALEWLALIYWNDDKRYSPS LKSRLTITRDTSKNQVVLTMTNMDPVDTATYY CTHRDAAMVYFDYWGQGTLVTVSS | 1269 | SSELTQDPAVSVALGQTVRITCQGDSLRS YYASWYQQKPGQAPVLVIYGKNNRPSGIP DRFSGSSSGNTASLTITGAQAEDEADYYC NSRDSSGNHWVFGGGTKLTVL |
| 1141 | QVQLVQSGAEVKKPGASVKVSCKASGYTFTSY GISWVRQAPGQGLEWMGWISAYNGNTNYAQKL QGRVTMTTDTSTSTAYMELRSLRSDDTAVYYC ARWYYGSGSYFDYWGQGTLVTVSS | 1270 | SYELTQPPSVSVSPGQTARITCSGDALPK KYAYWYQQKSGQAPVLVIYEDSKRPSGIP ERFSGSSSGTMATLTISGAQVEDEADYYC YSTDSSGNHRVFGGGTKLTVL |
| 1142 | EVQLVESGGGLVQPGGSRRLSCAASGFTFSRY DMHWVRQGTGKGLEWVSGINTAGDTYYSGSVK GRFTISRENAKNSLHLQMNSLRAGDTAVYYCA RGWNYGSGSCFDNWGQGTLVTVSS | 1271 | SSELTQDPAVSVALGQTVRITCQGDNLRN YSVSWCQQRPGQAPTLVIFGKNNRPSGIP DRFSGSNSGNTASLTITGAQAEDEADYYC NSRDISGKHWVFGGGTKLTVL |

TABLE 7-continued

Full Heavy Chain (HC) and Light Chain (LC) Sequences for Anti-CD131
Antibodies

| SEQ ID NO | Full HC AA Sequence | SEQ ID NO | Full LC AA Sequence |
|---|---|---|---|
| 1143 | EVQLVESGGGLVQPGGSLRLSCAASGFTFSSS DMHWVRQAPGEGLEWVSAIYTTGDTYYPGSVQ GRFTISRENAKNSLYLQMNSLRAGDTAVYYCA RGFSGTYYGDFDYWGQGTLVTVSS | 1272 | SYELTQPPSVSVSPGQTARITCSGDALPK KYAYWYQQKSGQAPVLVIYEDSKRPSGIP ERFSGSSSGTMATLTISGAQVEDEADYYC YSTDSSGNHWVFGGGTKLTVL |
| 1144 | EVQLVESGGGLVQPGGSLRLSCAASGFTFSSY SMNWVRQAPGKGLEWVSYISSSSSTIYYADSV KGRFTISRDNAKNSLYLQMNSLRDEDTAVYYC AREGEWEPLHMDVWGKGTTVTVSS | 1273 | SYELTQPPSVSVSPGQTARITCSGDALPK KYAYWYQQKSGQAPVLVIYEDSKRPSGIP ERFSGSSSGTMATLTISGAQVEDEADYYC YSTDSSGNHRVFGGGTKLTVL |
| 1145 | EVQLVESGGGLVQPGGSLRLSCAASGFTFSSY AMSWVRQAPGKGLEWVSAISGSGGSTYYADSV KGRFTISRDNSKNTLYLQMNSLRAEDTAVYYC AKSLSGSYVYMDVWGKGTTVTVSS | 1274 | SYELTQPPSVSVSPGQTARITCSGDALPK KYAYWYQQKSGQAPVLVIYEDSKRPSGIP ERFSGSSSGTMATLTISGAQVEDEADYYC YSTDSSGNHRVFGGGTKLTVL |
| 1146 | QVQLVESGGGVVQPGRSLRLSCAASGFTFSSY GMHWVRQAPGKGLEWVAVISYDGSNKYYADSV KGRFTISRDNSKNTLYLQMNSLRAEDTAVYYC AKGFLEWLLGFDYWGQGTLVTVSS | 1275 | SSELTQDPAVSVALGQTVRITCQGDSLRS YYASWYQQKPGQAPVLVIYGKNNRPSGIP DRFSGSSSGNTASLTITGAQAEDEADYYC NSRDSSGNHWVFGGGTKLTVL |
| 1147 | QVQLVESGGGLVKPGGSLRLSCAASGFTFSDY YMSWIRQAPGKGLEWVSYISSSGSTIYYADSV KGRFTISRDNSKNTLYLQMNSLRAEDTAVYYC ARDGGSSGYYSDYWGQGTLVTVSS | 1276 | SYVLTQPPSVSVAPGKTARITCGGNNIGS KSVHWYQQKPGQAPVLVIYYDSDRPSGIP ERFSGSNSGNTATLTISRVEAGDEADYYC QVWDSSSDHVVFGGGTKLTVL |
| 1148 | EVQLVESGGGLVQPGGSLRLSCAASGFTFSEY WMHWVRQAPGKGLVWVARINSDGSRTDYADSV KGRFTISRNNAKNRLNLQIDSLRAEDTAVYYC TRDLVYSSGWYDYWGQGTLVTVSS | 1277 | SSELTQDPAVSVALGQTVRITCQGDSLRS YYANWYQQKPGQAPILVIYGKNNRPSGIP DRFSGSSSGNTASLTITGAQAEDESDYYC NSRDSSGNHWVFGGGTKLTVL |
| 1149 | EVQLVESGGGLVQPGGSLRLSCAASGFTFSSY WMHWVRQAPGKGLVWVSRINSDGSGTSYADSV KGRFTISRDNAKNTLYLQMNSLRAEDTAVYYC AREGIKASDAFDIWGQGTMVTVSS | 1278 | SSELTQDPAVSVALGQTVRITCQGDSLRT YYASWYQQKPGQAPILVIYGKNNRPSGIP DRFSGSSSGNTASLTITGAQAEDEADYSC NSRDSSGSHVVFGGGTKLTVL |
| 1150 | EVQLVESGGGLVQPGRSLRLSCAASGFTFDDY AMHWVRQAPGKGLEWVSGISWNSGSIGYADSV KGRFTISRDNAKNSLYLQMNSLRAEDTALYYC AKDIDPSITGTDYWGQGTLVTVSS | 1279 | SYELTQPPSVSVSPGQTARITCSGDALPK KYAYWYQQKSGQAPVLVIYEDSKRPSGIP ERFSGSSSGTMATLTISGAQVEDEADYYC YSTDSSGNHSVVFGGGTKLTVL |
| 1151 | QVQLVESGGGLVKPGGSLRLSCAASGFTFSDY YMSWIRQAPGKGLEWVSYISHSGTTVYYADSV KGRFTISRDNAKISLYLQMNSLRAEDTAVYYC AGLRHFDWLGFDSWGQGTLVTVSS | 1280 | QTVVTQEPSLTVSPGGTVTLTCASSTGAV TSGYYPNWFQQKPGQAPRALIYSTSNKHS WTPARFSGSLLGGKAALTLSGVQPEDEAE YYCLLYYGGAWVFGGGTKLTVL |
| 1152 | EVQLVESGGGLVQPGGSLRLSCAASGFTFSSY AMNWVRQAPGKGLEWVSIINDSGYSTYYADSV KGRFTISRDNSKNTLYLQMNSLRAEDTALYYC AKEDNWNYGWFDPWGQGTLVTVSS | 1281 | QSALTQPASVSGSPGQSITISCTGTSSDV GGYNYVSWYQQHPGKAPKVIIYEVIIRPS GVSPRFSGSKSGKMASLTISGLQAEDEAD YYCSSYTSSSTWVFGGGTKLTVL |
| 1153 | EVQLVESGGGLVQPGGSLRLSCAASGFTFSSY DMHWVRQATGKGLEWVSAIGTAGDTYYPGSVK GRFTISRENAKNSLYLQMNSLRAGDTAVYYCA REETGTTSWYFDLWGRGTLVTVSS | 1282 | QSALTQPASVSGSPGQSITISCTGTSSDV GGYNYVSWYQQHPGKAPKLMIYEVSNRPS GVSNRFSGSKSGNTASLTISGLQAEDEAD YYCSSYTSSSTLYVFGTGTKVTVL |
| 1154 | EVQLVESGGGLVQPGGSLRLSCAASGFTFSSY SMNWVRQAPGKGLEWVSYISSSSSTIYYADSV KGRFTISRDNAKNSLYLQMNSLRDEDTAVYYC ARGYSYGYWYFDLWGRGTLVTVSS | 1283 | QSALTQPASVSGSPGQSITISCTGTSSDV GGYNYVSWYQQHPGKAPKLMIYEVSNRPS GVSNRFSGSKSGNTASLTISGLQAEDEAD YYCSSYTSSSTPYVFGTGTKVTVL |
| 1155 | QVQLVQSGAEVKKPGASVKVSCKVSGYTLTEL SMHWVRQAPGKGLEWMGGFDPEDGETIYAQKF QGRVTMTEDTSTDTAYMDLSSLRSEDTAVYYC ATPYCSGGSCHFDYWGQGTLVTVSS | 1284 | SYELTQPPSVSVSPGQTASITCSGDKLGD KYACWYQQKPGQSPVLVIYQDSKRPSGIP ERFSGSNSGNTATLTISGTQAMDEADYYC QAWDSSTVVFGGGTKLTVL |
| 1156 | EVQLVESGGGLVKPGGSLRLSCAASGFTFSSY SMNWVRQAPGKGLEWVSSISSSSYIYYADSV KGRFTISRDNAKNSLYLQMNSLRAEDTAVYYC ARDDYGGNSVYFDYWGQGTLVTVSS | 1285 | SYELTQPPSVSVSPGQTARITCSGDALPK KYAYWYQQKSGQAPVLVIYEDSKRPSGIP ERFSGSSSGTMATLTISGAQVEDEADYYC YSTDSSGNHRVFGGGTKLTVL |
| 1157 | QVQLVESGGGAVQPGRSLRLSCVASGFTFSNY DMHWVRQAPGKGLEWVAVIWSDGSNKYYSDSV KGRFTISRDNSKNTLYLQMTSLSAEDSALSYC VRAARYSGTYIFDYWGQGTLVTVSS | 1286 | SYVLTQSPSMSVAPGKTARITCGGNNIGS KSVHWYQQRPGQAPVLVIYYDSDRPSGIP ERFSGSNSGNTATLTISRVEAGDEAVYYC QVWDSSSYHYVFGTGTKVAVL |

TABLE 7-continued

Full Heavy Chain (HC) and Light Chain (LC) Sequences for Anti-CD131
Antibodies

| SEQ ID NO | Full HC AA Sequence | SEQ ID NO | Full LC AA Sequence |
|---|---|---|---|
| 1158 | EVQLVESGGGLVKPGGSLRLSCAASGFTFSNA WMSWVRQAPGKGLEWVGRIKSKTDGGTTDYAA PVKGRFAISRDDSKNTLYLQMNSLKTEDTAVY YCTTDPGYSYGVDYWGQGTLVTVSS | 1287 | SYELTQPPSVSVSPGQTARITCSGDALPK KYAYWYQQKSGQAPVLVIYEDSKRPSGIP ERFSGSSSGTMATLTISGAQVEDEADYYC YSTDSSGNHRVFGGGTKLTVL |
| 1159 | EVQLVQSGAEVKKPGESLKISCKGSGYSFTSY WIGWVRQMPGKGLEWMGIIYPGDSDTRYSPSF QGQVTISADKSISTAYLQWSSLKASDTAMYYC ARPEYSSSSGYFQHWGQGTLVTVSS | 1288 | SYELTQPPSVSVSPGQTARITCSGDALPK KYAYWYQQKSGQAPVLVIYEDSKRPSGIP ERFSGSSSGTMATLTISGAQVEDEADYYC YSTDSSGNHRVFGGGTKLTVL |
| 1160 | EVQLVESGGGLVQPGGSLRLSCAASGFTFSSY WMSWVRQAPGKGLEWVANIKQDGSEKYYVDSV KGRFTISRDNAKNSLYLQMNSLRAEDTAVYYC AREYNWNYEDAFDIWGQGTMVTVSS | 1289 | QTVVTQEPSLTVSPGGTVTLTCASSTGAV TSGYYPNWFQQKPGQAPRALIYSTSNKHS WTPARFSGSLLGGKAALTLSGVQPEDEAE YYCLLYYGGAQVFGGGTKLTVL |
| 1161 | QITLKESGPTLVKPTQTLTLTCTFSGFSLSTS GVGVGWIRQPPGKALEWLALIYWNDDKRYSPS LKSRLTITKDTSKNQVVLTMTNMDPVDTATYY CAHRRGSYSNWFDPWGQGTLVTVSS | 1290 | QSALTQPASVSGSPGQSITISCTGTSSDV GGYNYVSWYQQHPGKAPKLMIYDVSKRPS GVSNRFSGSKSGNTASLTISGLQAEDEAD YYCCSYAGSSTWVFGGGTKLTVL |
| 1162 | QIQLVQSGAEVKKPGASVKVSCTASGYTFSSY GITWVRQAPGQGLEWMGWISAYNGNTHYAQNL QGRVTMTTDTSTTAYMDLRSLRSDDTAIYYC ARTLFGVVKNWFDPWGQGTLVTVSS | 1291 | QSVLSQPPSVSEAPRQRVTISCSGSSSNI GNNAVNWYQKLPGKAPKLLISHDVLLSSG VSDRFSGSKSGTSASLAISGLQSEDEADY YCAAWDGRLNEWVFGGGTKLTVL |
| 1163 | QVQLVQSGASVKVSCKASGYTFTGYYMHWVRQ APGQGLEWMGWINPNSGGTNYAQKFQGRVTMT RDTSISTAYMELSRLRSDDTAVYYCAREVLGG GDCPFDYWGQGTLVTVSS | 1292 | QSVLTQPPSASGTPGQRVTISCSGSSSNI GSNTVNWYQQLPGTAPKLLIYSNNQRPSG VPDRFSGSKSGTSASLAISGLQSEDEADY YCAAWDDSLNGVVFGGGTKLTVL |
| 1164 | QVQLVQSGAEVRKPVASVKVSCKASGYTFTDH SIHWVRQAPGQGLEWMGSINPNSGGTNYAQKF QGRVTMTWDTYNSTAFMELSRLRSDDTAVYYC ARSDGGSHYVFFDDWGQGTLVTVSS | 1293 | QSVLTQPPSVSEAPRQRVTISCSGSISNI GNNAVSWYQQVPGKAPKLLIYYDDLLPSG VSDRFSGSRSVTSASLAISGLQSEDDADY YCTAWDDRLNGPVFGGGTKLTVL |
| 1165 | EVQLVESGGGLVQPGRSLRLSCAASGFTFDDY AMHWVRQAPGKGLEWVSGISWNSGSIGYADSV KGRFTISRDNAKNSLYLQMNSLRAEDTALYYC AKDIAYSSSGHFDYWGQGTLVTVSS | 1294 | QSALTQPPSASGSPGQSVTISCTGTSSDV GGYNYVSWYQQHPGKAPKLMIYEVSKRPS GVPDRFSGSKSGNTASLTVSGLQAEDEAD YYCSSYAGSNNLVFGGGTKLTVL |
| 1166 | QVQLQESGPGLVKPSGTLSLTCVVSGGSITSS NWWSWVRQPPGKGLEWIGEIYHSGNTNYNPSL KSRVTISVDKSKNQFSLRLSSVTAADTAVYYC ARAPLTGTTNWFDPWGQGTLVTVSS | 1295 | QSVLTQPPSVSGAPGQRVTISCSGSSSNI GAGYDVHWYQQLPGTGPKVLIYGNRNRPS GVPDRFSGSKSGTSASLVITGLQAEDEAD YSCQSYDSSLSGWVFGGGTKLTVL |
| 1167 | EVQLVESGGGLVKPGGSLRLSCAASGFTFSSY SMNWVRQAPGKGLEWVSSISSSSSYIYYADSV KGRFTISRDNAKNSLYLQMNSLRAEDTAVYYC AGVLYYDSSGYPFDYWGQGTLVTVSS | 1296 | SYELTQPSSVSVSPGQTARITCSGDVLAK KYARWFQQKPGQAPVLVIYKDSERPSGIP ERFSGSSSGTTVTLTISGAQVEDEADYYC YSAADNNLVFGGGTKLTVL |
| 1168 | QVQLVQSGSELKKPGASVKVSCKASGYTFTSY AMNWVRQAPGQGLEWMGWINTNTGNPTYAQGF TGRFVFSLDTSVSTAYLQISSLKAEDTAVYYC ARDPLAARPVGWFDPWGQGTLVTVSS | 1297 | SYELTQPPSVSVSPGQTASITCSGDKLGD KYACWYQQKPGQSPVLVIYQDSKRPSGIP ERFSGSNSGNTATLTISGTQAMDEADYYC QAWDSSTAVFGGGTKLTVL |
| 1169 | EVQLVESGGGLVKPGGSLRLSCAASGFTFSSY SMNWVRQAPGKGLEWVSSISSSSSYIYYADSV KGRFTISRDNAKNSLYLQMNSLRAEDTAVYYC AREDGYSSGWNYFDYWGQGTLVTVSS | 1298 | SSELTQDPAVSVALGQTVRITCQGDSLRS YYASWYQQKPGQAPVLVIYGKNNRPSGIP DRFSGSSSGNTASLTITGAQAEDEADYYC NSRDSSGNHWVFGGGTKLTVL |
| 1170 | QVQLVQSGAEVKKPGASVKVSCKVSGYTLTEL SMHWVRQAPGKGLEWMGGFDPEDGETIYAQKF QGRVTMTEDTSTDTAYMDLSSLRSEDTAVYYC ATGGQTIVAARVFDYWGQGTLVTVSS | 1299 | SYVLTQPPSVSVAPGKTARITCGGNNIGS KSVHWYQQKPGQAPVLVIYYDSDRPSGIP ERFSGSNSGNTATLTISRVEAGDEADYYC QVWDSSSDHVVFGGGTKLTVL |
| 1171 | QVQLVQSGSELKKPGASVKVSCKASGYTVTRH ALNWVRQAPGQGLEWMGWINTNTGTPTYAQGF IGRFVFTLDTSVSTAYLQINSLKAEDTAVYYC ARDQTPSDHYYYMDVWGKGTTVTVSS | 1300 | SSELTQDPAVSVALGQTVRITCQGDSLRS YYASWYQQKPGQAPVLVIYGKNNRPSGIP DRFSGSSSGNTASLTITGAQAEDEADYYC NSRDSSGNHYVFGTGTKVTVL |
| 1172 | LAHLVQSGAEVKRPGASVKVSCKAFGYAFRGQ HIHWVRQAPGQGLEWMGWIRPNSGDTNYSQKF QGRVTMTRDTSITTAYMELTRLRSDDSAVYYC ARDRGITMRLDNMDVWGKGTMVTVSS | 1301 | SSELTQDPAVSVALGQTVRITCQGDSLRS YYASWYQQKPGQAPVLVIYGKNNRPSGIP DRFSGSSSGNTASLTITGAQAEDEADYYC NSRDSSGNHLVFGGGTKLTVL |

TABLE 7-continued

Full Heavy Chain (HC) and Light Chain (LC) Sequences for Anti-CD131
Antibodies

| SEQ ID NO | Full HC AA Sequence | SEQ ID NO | Full LC AA Sequence |
|---|---|---|---|
| 1173 | EVQLVESGGTLVQPGGSLTLSCAASGFTFSDS AMHWVRQASGKGLEWVGRIRGKPNTYATAYAA SVKGRFTISKDDSKNTAFLQMNSLKTEDRAVY YCTRRYNWNDVGFDYWGQGTLVTVSS | 1302 | QSALTQPASVSGSPGQSITISCTGTSSDV GAYNYVSWYQQHPGKAPKEMIYDVSKRPS GVSNRFSGSKSGNTASLTISGLQAEDEAD YYCCSYAGSNTYVFGTGTRVTVL |
| 1174 | QITLKESGPTLVKPTQTLTLTCTFSGFSLSTS GVGVGWIRQPPGKALEWLALIYWNDDKRYSPS LKSRLTITKDTSKNQVVLTMTNMDPVDTATYY CAHRPGITGNTGYFDYWGQGTLVTVSS | 1303 | SYELTQPPSVSVSPGQTASITCSGDKLGD KYACWYQQKPGQSPVLVIYQDSKRPSGIP ERFSGSNSGNTATLTISGTQAMDEADYYC QAWDSSTVVFGGGTKLTVL |
| 1175 | QVQLVQSGAEVKKPGASVKVSCKASGYTFTSY GISWVRQAPGQGLEWMGWISAYNGNTNYAQKL QGRVTMTTDTSTSTAYMELRSLRSDDTAVYYC ARCRYSGSLTSYYMDVWGKGTTVTVSS | 1304 | SYELTQPPSVSVSPGQTASITCSGDKLGD KYACWYQQKPGQSPVLVIYQDSKRPSGIP ERFSGSNSGNTATLTISGTQAMDEADYYC QAWDSSTVVFGGGTKLTVL |
| 1176 | EVQLVESGGGLVQPGRSLRLSCAASGFTFDDY AMHWVRQAPGKGLEWVSGISWNSGSIGYADSV KGRFTISRDNAKNSLYLQMNSLRAEDTALYYC AKDMITGTTNYYMDVWGKGTTVTVSS | 1305 | SYELTQPPSVSVSPGQTASITCSGDKLGD KYACWYQQKPGQSPVLVIYQDSKRPSGIP ERFSGSNSGNTATLTISGTQAMDEADYYC QAWDSSTVVFGGGTKLTVL |
| 1177 | EVQLVESGGGLVQPGRSLRLSCAASGFTFDDY AMHWVRQAPGKGLEWVSGISRNSGSVGYADSV RGRFTISRDNAKNSLYLQMNSLRAEDTALYYC AKGGYDFWSGYYPFDPWGQGTLVTVSS | 1306 | SYELTQPLSVSVALGQTARITCGENNIVN KNVHWYQQKPGQAPVLVIYRDGNRPSGIP ERFSGSNSGNTATLTISRAQAGDEADYYC QVWDNNTPWVFGGGTKLTVL |
| 1178 | EVQLVESGGGLVKPGGSLRLSCAASGFTFSNA WMSWVRQAPGKGLEWVGRIKSKTDGGTTDYAA PVKGRFTISRDDSKNTLYLQMNSLKTEDTAVY YCTTEGTTVTTWAFDIWGQGTMVTVSS | 1307 | SYELTQPPSVSVSPGQTARITCSGDALPK KYAYWYQQKSGQAPVLVIYEDSKRPSGIP ERFSGSSSGTMATLTISGAQVEDEADYYC YSTDSSGNHRVFGGGTKLTVL |
| 1179 | QVQLQQSGPGLVKPSQTLSLTCAISGDSVSSN SAAWNWIRQSPSRGLEWLGRTYYRSKWYNDYA VSVKSRITINPDTSKNQFSLQLNSVTPEDTAV YYCASSGSYSDAFDIWGQGTMVTVSS | 1308 | SYELTQPPSVSVSPGQTARITCSGDALPK KYAYWYQQKSGQAPVLVIYEDSKRPSGIP ERFSGSSSGTMATLTISGAQVEDEADYYC YSTDSSGNHRVFGGGTKLTVL |
| 1180 | QVQLVQSGSELKKPGASVMVSCKASGYTFTRN GINWLRQAPGQGLEWMGWIDTHTGNPTYVQGF TGRFVFSLDTSVNTAYLQISSLRAEDTAVYYC AKDRTGYYHYYYFMDVWGKGTAVTVSS | 1309 | QSVLTQPPSASGAPGQRVTMSCSGSSSNI ERTAVNWYSHLPGAAPKLLIYSNDQRPLG VPDRFAGSKSGSSASLAISGLQSEDEAAY FCAAWDDSLNGWLFGGGTKLTVL |
| 1181 | QVQLVQSGTEMKKPGASVKVSCKASGYTFTTY GISWVRQAPGQGLEWMGWISAYNGNTNYAQKL QARVTMTTDTSTNTAYMELRSLRSDDTAVYYC ARSGYNWKYDYYYMDVWGKGTTVTVSS | 1310 | QSVLTQPPSVSGAPGQRVTISCTGNSSNI GADYDVQWYQQFPGTAPKLLIYANIIRPS GVPDRFSGSKSGTSASLAITGLQAEDEAD YYCQSYDSSLSGSLVFGGGTKLTVL |
| 1182 | EVQLVESGGGLVQPGGSLRLSCAASGFTFSSY WMSWVRQAPGKGLEWVANIKQDGSEKYYVDSV KGRFTISRDNAKNSLYLQMNSLRAEDTAVYYC AREGGYDFWSGLNWFDPWGQGTLVTVSS | 1311 | SYELTQPPSVSVSPGQTARITCSGDALPK KYAYWYQQKSGQAPVLVIYEDSKRPSGIP ERFSGSSSGTMATLTISGAQVEDEADYYC YSTDSSGNHRVFGGGTKLTVL |
| 1183 | QVQLVQSGAEVKKPGASVKVSCKASGYTFTSY GISWVRQAPGQGLEWMGWISAYNGNTNYAQKL QGRVTMTTDTSTSTAYMELRSLRSDDTAVYYC ARAGGIAAAGTGYWFDPWGQGTLVTVSS | 1312 | SYELTQPPSVSVSPGQTARITCSGDALPK KYAYWYQQKSGQAPVLVIYEDSKRPSGIP ERFSGSSSGTMATLTISGAQVEDEADYYC YSTDSSGNHRVFGGGTKLTVL |
| 1184 | EVQLVESGGGLVKPGGSLRLSCAASGFTFSNA WMSWVRQAPGKGLEWVGRIKSKTDGGTTDYAA PVKGRFTISRDDSKNTLYLQMNSLKTEDTAVY YCTTADYDFWSGYYMDVWGKGTTVTVSS | 1313 | SSEMTQDPAVSVALGQTVRITCQGDSLRS YYASWYQQKPGQAPVLVIYGKNNRPSGIP DRFSGSSSGNTASLTITGAQAEDEADYYC NSRDSSGNHWVFGGGTKLTVL |
| 1185 | QVQLQQSGPGLVKPSQTLSLTCAISGDSVSSN SAAWNWIRQSPSRGLEWLGRTYYRSKWYNDYA VSVKSRITINPDTSKNQFSLQLNSVTPEDTAV YYCARDLELRGGAFDIWGQGTMVTVSS | 1314 | SYELTQPPSVSVSPGQTARITCSGDALPK KYAYWYQQKSGQAPVLVIYEDSKRPSGIP ERFSGSSSGTMATLTISGAQVEDEADYYC YSTDSSGNHRVFGGGTKLTVL |
| 1186 | EVHLVESGGGLVRPGGSLRLSCEVSGFTFSTY SMNWVRQAPGKGLEWVSSISSRSSYIYYADSV KGRFTISRDNAKNSLYLQMNSLRAEDTAVYYC TRGEGATWGNYHCYYMDVWGKGTTVIVSS | 1315 | SYELTQPPSVSVSPGQTARITCSGDALPK KYAYWYQQKSGQAPVLVIYEDSKRPSGIP ERFSGSSSGTMATLTISGAQVEDEADYYC YSTDSSGNHRVFGGGTKLTVL |
| 1187 | QVQLVQSGAEVKKPGASVKVSCKASGYSFTGY YMHWVRQAPGQGLEWMGWINPNSGGTNYAQKF QGRVTMTWDTSISTAYMELSRLRSDDTAVYYC ARDQITMVRGFLGDWFDPWGQGTLVTVSS | 1316 | SSELTQDPAVSVALGQTVRITCQGDSLRS YYASWYQQKPGQAPVLVIYGKNNRPSGIP DRFSGSSSGNTASLTITGAQAEDEADYYC NSRDSSGNHLVFGGGTKLTVL |

TABLE 7-continued

| | Full Heavy Chain (HC) and Light Chain (LC) Sequences for Anti-CD131 Antibodies | | |
|---|---|---|---|
| SEQ ID NO | Full HC AA Sequence | SEQ ID NO | Full LC AA Sequence |
| 1188 | QLQLQESGPGLVKPSETLSLTCTVSGGSISSS SYYWGWIRQPPGKGLEWIGSIYYSGSTYYNPS LKSRVTISVDTSKNQFSLKLSSVTAADTAVYY CARGYSYEFDYWGQGTLVTVSS | 1317 | SYELTQPPSVSVSPGQTARITCSGDALPK KYAYWYQQKSGQAPVLVIYEDSKRPSGIP ERFSGSSSGTMATLTISGAQVEDEADYYC YSTDSSGNHRVFGGGTKLTVL |
| 1189 | QVQLQQSGPGLVKPSQTLSLTCAISGDSVSSN SAAWNWIRQSPSRGLEWLGRTYYRSKWYNDYA VSVKSRITINPDTSKNQFSLQLNSVTPEDTAV YYCAREEIVGATTAFDIWGQGTMVTVSS | 1318 | SYVLTQPPSVSVAPGKTARITCGGNNIGS KSVHWYQQKPGQAPVLVIYYDSDRPSGIP ERFSGSNSGNTATLTISRVEAGDEADYYC QVWDSSSDHWVFGGGTKLTVL |
| 1190 | QVQLQQSGPGLVKPSQTLSLTCAISGDSVSSN SAAWNWIRQSPSRGLEWLGRTYYRSKWYNDYA VSVKSRITINPDTSKNQFSLQLNSVTPEDTAV YYCARDYGGNSGWYFDLWGRGTLVTVSS | 1319 | SYELTQPPSVSVSPGQTARITCSGDALPK KYAYWYQQKSGQAPVLVIYEDSKRPSGIP ERFSGSSSGTMATLTISGAQVEDEADYYC YSTDSSGNHRVFGGGTKLTVL |
| 1191 | QVQLQQWGAGLLKPSETLSLTCAVYGGSFSGH YWNWIRQPPGKGLEWIGEINHSGFTNYNPSLK SRVTISVDTPKNQFSLNLSSVTAADTAVYYCA REGLTGHVFDIWGQGTMVTVSS | 1320 | QSALTQPASVSGSPGQSITISCTGTSSDV GVYNYVSWYQQHPTKAPKLMIYEVSNRPS GVSNRFSGSKSGNTASLTISGLQAEDEAD YYCSSYTSSITWVFGGGTKLTVL |
| 1192 | QVQVQQSGPGLVKPSQTLSLTCAISGDSVSSN SAAWNWIRQSPSRGLEWLGRTYYRSKWYNDFA VSVKSRITINPDTSKNQFSLQLNSVTPEDTAV YYCARGGGSGSYDWEDPWGQGTLVTVSS | 1321 | QSALTQPASVSGSPGQSITISCTGTSSDV GGYNVSWYQQHPGKAPKLMIYEVSNRPS GVSNRFSGSKSGNTASLTISGLQAEDEAD YYCSSYTSSSTWVFGGGTKLTVL |
| 1193 | EVRLVESGGGLVKPGGSLRLSCAASGFIFSSY SMTWVRQAPGKGLEWVSSISGSSSFVKYGDSV KGRFTISRDNAKNSLYLQMNSLRAEDTAVYYC AREGVLCSGGSCYREIFDYWGQVTLVTVSS | 1322 | SSELTQDPAVSVALGQTVRITCQGDSLRS YYASWYQQKPGQAPVLVIYGKNNRPSGIP DRFSGSSSGNTASLTITGAQAEDEADYYC NSRDSSGNHLVFGGGTKLTVL |
| 1194 | EVQLVESGEGLVKPGGSLRLSCVASGFDFTNA WMSWVRQAPGRGLEWVGRIKSKTDGGSIDYAA PVKGRFTISRDDSKTTLYLQMTSLRTEDTAVY YCSTSPYYDFWSGYYGYIDYWGQGTLVTVSS | 1323 | QSVLTQPPSVSGAPGQRVTISCTGSSSNI GAGYAVHWYQQFPGIAPKLLIYGNINRPS GVPDRFSGSKSDTSASLAITGLQAEDEAD YYCQSFDSSLSGVMFGGGTKLTVL |
| 1195 | EVHLVESGGGLVKPGGSLRLSCVASRFTFSSA WMTWVRQVPGKGLEWIGRIKTKTEGGTTEYAA PVKGRFAISRDDSKKTLYLQMNSLKTEDTAVY YCSTSPYFDFWSGYYGYLDYWGQGTLVTVSS | 1324 | WAQSVLTQPPSVSGAPGQRVTISCSGSSS NIGAGYAVHWYQLLPGTVPKLLIYGNLNR PSGVPDRFSGSMSDTSVSLAITGLQAEDE ADYYCQSYDSSLSGVVFGGGTKVTVL |
| 1196 | QLQLQESGPGLVKPSETLSLTCTVSGGSISSS SYYWGWIRQPPGKGLEWIGSIYYSGSTYYNPS LKSRVTISVDTSKNQFSLKLSSVTAADTAVYY CARHAAAGGWFDPWGQGTLVTVSS | 1325 | QAVLTQPASLSASPGASASLTCTLRSGIN VGTYRIYWYQQKPGSPPQYLLRYKSDSDK QQGSGVPSRFSGSKDASANAGILLISGLQ SEDEADYYCMIWHSSAVVFGGGTKLTVL |
| 1197 | QLQLQESGPGLVKPSETLSLTCTVSGGSISSS SYYWGWIRQPPGKGLEWIGSIYYSGSTYYNPS LKSRVTISVDTSKNQFSLKLSSVTAADTAVYY CARRSSSGIGAFDIWGQGTMVTVSS | 1326 | SYELTQPPSVSVSPGQTASITCSGDKLGD KYACWYQQKPGQSPVLVIYQDSKRPSGIP ERFSGSNSGNTATLTISGTQAMDEADYYC QAWDSSTVVFGGGTKLTVL |
| 1198 | QVQLQQWGAGLLKPSETLSLTCAVYGGSFSGY YWSWIRQPPGKGLEWIGEINHSGSTNYNPSLK SRVTISVDTSKNQFSLKLSSVTAADTAVYYCA RGRGIAARPPYFDYWGQGTLVTVSS | 1327 | SYVLTQPPSVSVAPGKTARITCGGNNIGS KSVHWYQQKPGQAPVLVIYYDSDRPSGIP ERFSGSNSGNTATLTISRVEAGDEADYYC QVWDSSSDHVVFGGGTKLTVL |
| 1199 | QLQLQESGPGLVKPSETLSLTCTVSGGSISSS SYYWGWIRQPPGKGLEWIGSIYYSGSTYYNPS LKSRVTISVDTSKNQFSLKLSSVTAADTAVYY CASEYSSSSLDAFDIWGQGTMVTVSS | 1328 | SYELTQPPSVSVSPGQTARITCSGDALPK KYAYWYQQKSGQAPVLVIYEDSKRPSGIP ERFSGSSSGTMATLTISGAQVEDEADYYC YSTDSSGNHRVFGGGTKLTVL |
| 1200 | QVQLQQWGAGLLKPSETLSLTCAVYGGSFSGY YWSWIRQPPGKGLEWIGEINHSGTNYNPSLK SRVTISVDTSKNQFSLKLSSVTAADTAVYYCA RGTTVVTPTEYYYMDVWGKGTTVTVSS | 1329 | SYELTQPPSVSVSPGQTASITCSGDKLGD KYACWYQQKPGQSPVLVIYQDSKRPSGIP ERFSGSNSGNTATLTISGTQAMDEADYYC QAWDSSTVVFGGGTKLTVL |
| 1201 | QVQLVQSGAEVKKPGASVKVSCKASGYTFTSY DINWVRQATGQGLEWMGWLNPKNGYTGYSHKF QGRVTMTRNTSISTAYMELSSLRSEDAAVYFC ARRGDFWSGYYSTSQNIVIHWFDSWGLGTLVT VSS | 1330 | QSVLTQPPSVSGAPGQRVTISCTGSSSNI GAGYDVHWYQQLPGTAPKLLIYGNSNRPS GVPDRFSGSKSGTSASLAITGLQAEDEAD YYCQSYDSSLSGSVFGGGTKLTVL |

TABLE 8

VH-CDR3 and VL-CDR3 Sequences for EPOR/CD131 Binders

| clonotype_id | fre-quency | VH Gene | VL Gene | VH-CDR3 AA | SEQ ID NO | VL-CDR3 AA | SEQ ID NO | Full HC AA Sequence SEQ ID NO | Full LC AA Sequence SEQ ID NO |
|---|---|---|---|---|---|---|---|---|---|
| clonotype 7 | 17 | IGHV1-8 | IGLV3-1 | CARWGRGFDPW | 1331 | CQAWDSS TAVF | 1467 | 1603 | 1739 |
| clonotype 9 | 10 | IGHV1-69D | IGLV2-23 | CARERLELRWE DPW | 1332 | CCSYAGS STWVF | 1468 | 1604 | 1740 |
| clonotype 14 | 8 | IGHV4-39 | IGLV2-23 | CARQTDYWFDP W | 1333 | CCSYAGS STLVFE | 1469 | 1605 | 1741 |
| clonotype 15 | 6 | IGHV3-21 | IGLV2-14 | CAREGGIAVAG FDYW | 1334 | CSSYTSS STLVF | 1470 | 1606 | 1742 |
| clonotype 17 | 5 | IGHV3-13 | IGLV3-9 | CARDSSSWYED AFDIW | 1335 | CQVWDSS TVVF | 1471 | 1607 | 1743 |
| clonotype 19 | 5 | IGHV3-11 | IGLV2-14 | CAREETMVRGV IAYW | 1336 | CSSYTSS STVVF | 1472 | 1608 | 1744 |
| clonotype 22 | 4 | IGHV3-21 | IGLV3-10 | CARDWGSFDLW | 1337 | CYSTDSS GNHWVF | 1473 | 1609 | 1745 |
| clonotype 29 | 4 | IGHV3-53 | IGLV2-8 | CARDGGEYSSS YYFDYW | 1338 | CSSYAGS NNVVF | 1474 | 1610 | 1746 |
| clonotype 32 | 4 | IGHV4-39 | IGLV4-3 | CARHDPSFDYW | 1339 | CGESHTI DGQVGVV F | 1475 | 1611 | 1747 |
| clonotype 38 | 3 | IGHV1-18 | IGLV3-21 | CARERSNWDED YW | 1340 | CQVWDSS SDHRVF | 1476 | 1612 | 1748 |
| clonotype 42 | 2 | IGHV3-7 | IGLV3-1 | CARDGGVRGVI TYFDYW | 1341 | CQAWDSS NVVF | 1477 | 1613 | 1749 |
| clonotype 43 | 2 | IGHV1-8 | IGLV3-1 | CARGRGSSWYW YFDLW | 1342 | CQAWDSS TAVF | 1478 | 1614 | 1750 |
| clonotype 44 | 2 | IGHV3-13 | IGLV3-9 | CARGSSSSAFD IW | 1343 | CQVWDSS TWVF | 1479 | 1615 | 1751 |
| clonotype 45 | 2 | IGHV3-21 | IGLV3-27 | CARDGGIAAAG TDYW | 1344 | CYSAADN NLVF | 1480 | 1616 | 1752 |
| clonotype 56 | 2 | IGHV3-21 | IGLV3-10 | CARADSLTGGF FDYW | 1345 | CYSTDSS GNHSWVF | 1481 | 1617 | 1753 |
| clonotype 57 | 2 | IGHV7-4-1 | IGLV7-46 | CAERGWNYDYW | 1346 | CLLSYSG AWVF | 1482 | 1618 | 1754 |
| clonotype 65 | 2 | IGHV3-53 | IGLV2-14 | CARDSTTVTLF DYW | 1347 | CSSYTSS STYVF | 1483 | 1619 | 1755 |
| clonotype 68 | 2 | IGHV3-21 | IGLV2-8 | CARGIAVAGPH AFDIW | 1348 | CSSYAGS NNFVVF | 1484 | 1620 | 1756 |
| clonotype 70 | 2 | IGHV3-53 | IGLV1-40 | CARGYSGSYAY W | 1349 | CQSYDSS LSGYVF | 1485 | 1621 | 1757 |
| clonotype 72 | 2 | IGHV6-1 | IGLV2-23 | CARKWELRDAF DIW | 1350 | CCSYAGR STLGIDW VF | 1486 | 1622 | 1758 |
| clonotype 74 | 2 | IGHV5-51 | IGLV3-21 | CAKRRMTGSHS WEDPW | 1351 | CQVWDNG SDHVVF | 1487 | 1623 | 1759 |
| clonotype 215 | 1 | IGHV3-74 | IGLV2-14 | CARIDYW | 1352 | CSSYTSS STWVF | 1488 | 1624 | 1760 |
| clonotype 216 | 1 | IGHV3-7 | IGLV3-10 | CARDGGTP | 1353 | CYSTDSS GNHRVF | 1489 | 1625 | 1761 |
| clonotype 219 | 1 | IGHV4-59 | IGLV3-27 | CAIVGAREDYW | 1354 | CYSAADN NLVF | 1490 | 1626 | 1762 |

TABLE 8-continued

VH-CDR3 and VL-CDR3 Sequences for EPOR/CD131 Binders

| clonotype_ id | fre- quency | VH Gene | VL Gene | VH-CDR3 AA | SEQ ID NO | VL-CDR3 AA | SEQ ID NO | Full HC AA Sequence SEQ ID NO | Full LC AA Sequence SEQ ID NO |
|---|---|---|---|---|---|---|---|---|---|
| clonotype 221 | 1 | IGHV3- 15 | IGLV3- 25 | CTTGGTHW | 1355 | COSADSS GTWVF | 1491 | 1627 | 1763 |
| clonotype 223 | 1 | IGHV3- 15 | IGLV3- 25 | CTTGGYRW | 1356 | CQSADSS GTNWVF | 1492 | 1628 | 1764 |
| clonotype 224 | 1 | IGHV3- 15 | IGLV3- 10 | CTTDLYYW | 1357 | CYSTDSS GNHRVF | 1493 | 1629 | 1765 |
| clonotype 225 | 1 | IGHV1- 18 | IGLV2- 14 | CARGWYFDYW | 1358 | CSSYTSS STLVF | 1494 | 1630 | 1766 |
| clonotype 226 | 1 | IGHV3- 23 | IGLV2- 14 | CAKRVFFDYW | 1359 | CSSYTIS STWVF | 1495 | 1631 | 1767 |
| clonotype 228 | 1 | IGHV3- 13 | IGLV3- 10 | CARDLGRVFDY W | 1360 | CYSTDSS GNHRVF | 1496 | 1632 | 1768 |
| clonotype 229 | 1 | IGHV3- 7 | IGLV2- 14 | CATDLNWNGYW | 1361 | CSSYTRS RTWVF | 1497 | 1633 | 1769 |
| clonotype 230 | 1 | IGHV3- 13 | IGLV5- 45 | CATGYNWNPDY W | 1362 | CMIWHSS ASVF | 1498 | 1634 | 1770 |
| clonotype 231 | 1 | IGHV3- 33 | IGLV3- 27 | CARDRSSSSDY W | 1363 | CYSAADN NRVF | 1499 | 1635 | 1771 |
| clonotype 232 | 1 | IGHV3- 74 | IGLV3- 27 | CAGITGTYFDY W | 1364 | CYSAADN NLVF | 1500 | 1636 | 1772 |
| clonotype 233 | 1 | IGHV3- 43 | IGLV3- 10 | CAKDSGYSPDY W | 1365 | CYSTDSS GKGVF | 1501 | 1637 | 1773 |
| clonotype 234 | 1 | IGHV1- 18 | IGLV3- 10 | CARDRPYYFDY W | 1366 | CYSTDSS GNHRVF | 1502 | 1638 | 1774 |
| clonotype 235 | 1 | IGHV1- 46 | IGLV3- 19 | CARGGWGTMDV W | 1367 | CNSRDSS GNHYVF | 1503 | 1639 | 1775 |
| clonotype 236 | 1 | IGHV3- 13 | IGLV3- 19 | CARAWELDAFD IW | 1368 | CNSRDSS GNHVVF | 1504 | 1640 | 1776 |
| clonotype 237 | 1 | IGHV3- 23 | IGLV3- 10 | CAKDNWNYFDY W | 1369 | CYSTDSS GNHRVF | 1505 | 1641 | 1777 |
| clonotype 238 | 1 | IGHV3- 33 | IGLV3- 10 | CARVYNWIFDY W | 1370 | CYSTDSS GNHRVF | 1506 | 1642 | 1778 |
| clonotype 239 | 1 | IGHV3- 21 | IGLV2- 23 | CARITVVSFDY W | 1371 | CCSYAGS STWVF | 1507 | 1643 | 1779 |
| clonotype 240 | 1 | IGHV3- 23 | IGLV2- 8 | CAKAAAGKGDY W | 1372 | CSSYSGS NNYVF | 1508 | 1644 | 1780 |
| clonotype 241 | 1 | IGHV1- 46 | IGLV2- 14 | CARGDWGTMDV W | 1373 | CTSYTRN NTYVF | 1509 | 1645 | 1781 |
| clonotype 242 | 1 | IGHV3- 7 | IGLV1- 40 | CARDGTGWFDP W | 1374 | CQSYDSS LSGWVF | 1510 | 1646 | 1782 |
| clonot ype243 | 1 | IGHV1- 18 | IGLV2- 23 | CARRGTVVFDY W | 1375 | CCSYAGS STYVVF | 1511 | 1647 | 1783 |
| clonotype 244 | 1 | IGHV1- 18 | IGLV2- 23 | CARPLSGTLDN W | 1376 | CCSYAGR STLGIDW VF | 1512 | 1648 | 1784 |
| clonotype 246 | 1 | IGHV3- 48 | IGLV3- 19 | CARESIAALFD YW | 1377 | CNSRDSS GNHLVF | 1513 | 1649 | 1785 |

TABLE 8-continued

VH-CDR3 and VL-CDR3 Sequences for EPOR/CD131 Binders

| clonotype_ id | fre- quency | VH Gene | VL Gene | VH-CDR3 AA | SEQ ID NO | VL-CDR3 AA | SEQ ID NO | Full HC AA Sequence SEQ ID NO | Full LC AA Sequence SEQ ID NO |
|---|---|---|---|---|---|---|---|---|---|
| clonotype 247 | 1 | IGHV3- 13 | IGLV3- 16 | CARGDHSYGGL DYW | 1378 | CLSADSS GTYRVF | 1514 | 1650 | 1786 |
| clonotype 249 | 1 | IGHV1- 8 | IGLV2- 14 | CARGDWAWSFD LW | 1379 | CSSYTSS SSLVF | 1515 | 1651 | 1787 |
| clonotype 250 | 1 | IGHV1- 46 | IGLV2- 14 | CARGLRRDWFD PW | 1380 | CSSYTSS STWVF | 1516 | 1652 | 1788 |
| clonotype 251 | 1 | IGHV3- 15 | IGLV2- 11 | CTTGTGRSDYW | 1381 | CCSYSGS YTYVF | 1517 | 1653 | 1789 |
| clonotype 252 | 1 | IGHV3- 33 | IGLV2- 14 | CVRGGVGDGFD MW | 1382 | CISYTNT NTRVF | 1518 | 1654 | 1790 |
| clonotype 253 | 1 | IGHV3- 33 | IGLV2- 14 | CASVGSYGYFQ HW | 1383 | CSSYTSS STWVF | 1519 | 1655 | 1791 |
| clonotype 254 | 1 | IGHV3- 20 | IGLV2- 8 | CARKGNWNSFD YW | 1384 | CSSYAGS NNWVF | 1520 | 1656 | 1792 |
| clonotype 255 | 1 | IGHV3- 21 | IGLV2- 8 | CARDSAYYTFD YW | 1385 | CSSYAGS NNEWVF | 1521 | 1657 | 1793 |
| clonotype 256 | 1 | IGHV3- 23 | IGLV2- 14 | CGSGWYEGAFD YW | 1386 | CSSYTSS STYWVF | 1522 | 1658 | 1794 |
| clonotype 259 | 1 | IGHV3- 13 | IGLV3- 1 | CARDRDSSHDA FDIW | 1387 | CQAWDSS TVVE | 1523 | 1659 | 1795 |
| clonotype 260 | 1 | IGHV3- 20 | IGLV3- 27 | CVRDEIWNYYF DYW | 1388 | CYSAADN NRVF | 1524 | 1660 | 1796 |
| clonotype 262 | 1 | IGHV3- 21 | IGLV3- 10 | CARDSYDFHAF DIW | 1389 | CYSTDSS GNHRVF | 1525 | 1661 | 1797 |
| clonotype 264 | 1 | IGHV3- 74 | IGLV3- 19 | CARVGWGGHAF DIW | 1390 | CNSRDSS GNHVVF | 1526 | 1662 | 1798 |
| clonotype 265 | 1 | IGHV3- 21 | IGLV2- 14 | CARGYNWNYVG DYW | 1391 | CSSYTSS STLVF | 1527 | 1663 | 1799 |
| clonotype 266 | 1 | IGHV3- 23 | IGLV1- 40 | CAKDANWGYAF DIW | 1392 | CQSYDSS LSGSVF | 1528 | 1664 | 1800 |
| clonotype 270 | 1 | IGHV1- 18 | IGLV3- 1 | CARRFIWNYGD FDYW | 1393 | CQAWDSS TVVF | 1529 | 1665 | 1801 |
| clonotype 271 | 1 | IGHV3- 48 | IGLV3- 1 | CARGRLGIFDY FDYW | 1394 | CQAWDSS TVVF | 1530 | 1666 | 1802 |
| clonotype 272 | 1 | IGHV3- 48 | IGLV3- 19 | CARECYSSSWA FDYW | 1395 | CNSRDSS GWVF | 1531 | 1667 | 1803 |
| clonotype 273 | 1 | IGHV4- 4 | IGLV3- 1 | CARDVGVDGRG FDYW | 1396 | CQAWDST TAWVF | 1532 | 1668 | 1804 |
| clonotype 274 | 1 | IGHV3- 7 | IGLV3- 19 | CARDILWSGGY LDVW | 1397 | CYSRDSS GSLWIF | 1533 | 1669 | 1805 |
| clonotype 275 | 1 | IGHV3- 7 | IGLV3- 19 | CARKQLWLNWY FDFW | 1398 | CNSRDSS GNHLVF | 1534 | 1670 | 1806 |
| clonotype 276 | 1 | IGHV1- 18 | IGLV3- 19 | CARENNWNYGW FDPW | 1399 | CNSRDSS GNHYVF | 1535 | 1671 | 1807 |
| clonotype 277 | 1 | IGHV3- 13 | IGLV3- 10 | CAREGYGDYPL PMDVW | 1400 | CYSTDSS GNHRVF | 1536 | 1672 | 1808 |
| clonotype 278 | 1 | IGHV3- 15 | IGLV3- 10 | CTTDNWNSYFD YW | 1401 | CYSTDSS GNHRVF | 1537 | 1673 | 1809 |

TABLE 8-continued

VH-CDR3 and VL-CDR3 Sequences for EPOR/CD131 Binders

| clonotype_id | frequency | VH Gene | VL Gene | VH-CDR3 AA | SEQ ID NO | VL-CDR3 AA | SEQ ID NO | Full HC AA Sequence SEQ ID NO | Full LC AA Sequence SEQ ID NO |
|---|---|---|---|---|---|---|---|---|---|
| clonotype 279 | 1 | IGHV3-23 | IGLV3-10 | CAGNSGYDSPY FDYW | 1402 | CYSTDSS GNHRVF | 1538 | 1674 | 1810 |
| clonotype 280 | 1 | IGHV3-33 | IGLV3-10 | CAREYSSSSDW FDPW | 1403 | CYSTDSS GNHRVF | 1539 | 1675 | 1811 |
| clonotype 281 | 1 | IGHV3-21 | IGLV2-11 | CARDGGITGRY FDLW | 1404 | CCSYAGS YTWVF | 1540 | 1676 | 1812 |
| clonotype 282 | 1 | IGHV3-21 | IGLV2-23 | CAREGNWGPYY FDYW | 1405 | CCSYAGS STVVF | 1541 | 1677 | 1813 |
| clonotype 283 | 1 | IGHV1-2 | IGLV2-8 | CARGVWSGYYT FDPW | 1406 | CSSYAGS NNWVF | 1542 | 1678 | 1814 |
| clonotype 284 | 1 | IGHV3-15 | IGLV2-14 | CTPHSSSPVFD YW | 1407 | CSSYTSS SHVVF | 1543 | 1679 | 1815 |
| clonotype 286 | 1 | IGHV1-2 | IGLV3-1 | CARDDTGTTGG YFQHW | 1408 | CQAWDSS TVVF | 1544 | 1680 | 1816 |
| clonotype 287 | 1 | IGHV1-8 | IGLV3-1 | CARAVAVAGTG WFDPW | 1409 | CQAWDSS TVVF | 1545 | 1681 | 1817 |
| clonotype 288 | 1 | IGHV3-15 | IGLV3-27 | CTTNYGDYVGF DYW | 1410 | CYSAADN NLVF | 1546 | 1682 | 1818 |
| clonotype 289 | 1 | IGHV3-7 | IGLV3-10 | CAREIDWNYGF HFDYW | 1411 | CESTDSS GNKVF | 1547 | 1683 | 1819 |
| clonotype 290 | 1 | IGHV1-8 | IGLV3-10 | CARGYYDFWSG PFDYW | 1412 | CYSTDSS GNRVF | 1548 | 1684 | 1820 |
| clonotype 291 | 1 | IGHV3-33 | IGLV3-10 | CARDSKWELLN WFDPW | 1413 | CYSTDSS GNRVF | 1549 | 1685 | 1821 |
| clonotype 292 | 1 | IGHV4-59 | IGLV3-19 | CARGRHFDWLL SYFDYW | 1414 | CNSRDSS GNHYVF | 1550 | 1686 | 1822 |
| clonotype 293 | 1 | IGHV3-21 | IGLV3-19 | CARDRAIVGAT WEDPWGQGTLV IV | 1415 | CNSRDSS YNHWVF | 1551 | 1687 | 1823 |
| clonotype 294 | 1 | IGHV3-21 | IGLV3-19 | CARDRYNWNYR YFDLW | 1416 | CNSRDSS GNHLVF | 1552 | 1688 | 1824 |
| clonotype 295 | 1 | IGHV3-21 | IGLV3-10 | CARDSHDYGDS YFDYW | 1417 | CYSTDSS GNHRVF | 1553 | 1689 | 1825 |
| clonotype 296 | 1 | IGHV1-18 | IGLV3-19 | CARDGAARPPR YMDVW | 1418 | CNSRDSS GNHLVF | 1554 | 1690 | 1826 |
| clonotype 297 | 1 | IGHV1-2 | IGLV3-19 | CARSDSGSHYV FFDDW | 1419 | CNSRDSS GNHWVF | 1555 | 1691 | 1827 |
| clonotype 298 | 1 | IGHV1-2 | IGLV3-19 | CARDLDYYGSG NYDYW | 1420 | CNSRDSS DNHRVF | 1556 | 1692 | 1828 |
| clonotype 300 | 1 | IGHV3-74 | IGLV3-19 | CARNRDYHGSG SFDYW | 1421 | CNSRDSS GNHWVF | 1557 | 1693 | 1829 |
| clonotype 301 | 1 | IGHV6-1 | IGLV3-19 | CARDWNFAFDI W | 1422 | CNSRDSS GNHLVF | 1558 | 1694 | 1830 |
| clonotype 302 | 1 | IGHV1-18 | IGLV1-36 | CARTIFGVVNN WFDPW | 1423 | CAAWDAR LNGWVF | 1559 | 1695 | 1831 |
| clonotype 303 | 1 | IGHV1-2 | IGLV2-11 | CARDGEQLALN WFDPW | 1424 | CCSYAGS YTWVF | 1560 | 1696 | 1832 |
| clonotype 304 | 1 | IGHV3-21 | IGLV1-40 | CARETPVTLFD AFDIW | 1425 | CQSYDSS LSGSVF | 1561 | 1697 | 1833 |

TABLE 8-continued

VH-CDR3 and VL-CDR3 Sequences for EPOR/CD131 Binders

| clonotype_ id | fre- quency | VH Gene | VL Gene | VH-CDR3 AA | SEQ ID NO | VL-CDR3 AA | SEQ ID NO | Full HC AA Sequence SEQ ID NO | Full LC AA Sequence SEQ ID NO |
|---|---|---|---|---|---|---|---|---|---|
| clonotype 305 | 1 | IGHV3- 43 | IGLV1- 40 | CAKDIFTGRAG YFDYW | 1426 | CQSYDSS LSGWVF | 1562 | 1698 | 1834 |
| clonotype 306 | 1 | IGHV3- 33 | IGLV1- 40 | CARAITGTTGN WFDPW | 1427 | CQSYDSS LSGWVF | 1563 | 1699 | 1835 |
| clonotype 307 | 1 | IGHV2- 5 | IGLV5- 45 | CTHTEYGSSWS VDYW | 1428 | CMIWHSS AVVF | 1564 | 1700 | 1836 |
| clonotype 308 | 1 | IGHV3- 20 | IGLV5- 45 | CARHFDWLLSN AFDIW | 1429 | CMIWHSS ASVVF | 1565 | 1701 | 1837 |
| clonotype 309 | 1 | IGHV1- 8 | IGLV3- 1 | CVRRITVVRGV ISLDYW | 1430 | CQAWDSS TAVF | 1566 | 1702 | 1838 |
| clonotype 310 | 1 | IGHV3- 21 | IGLV3- 10 | CARETYYYDSS GYFDYW | 1431 | CYSTDSS GNHRVF | 1567 | 1703 | 1839 |
| clonotype 316 | 1 | IGHV3- 7 | IGLV3- 19 | CARDDTIFGVV TDAFDIW | 1432 | CNSRDSS GNLF | 1568 | 1704 | 1840 |
| clonotype 318 | 1 | IGHV6- 1 | IGLV3- 1 | CARGVGARGWF DPW | 1433 | CQAWDSS TAVF | 1569 | 1705 | 1841 |
| clonotype 319 | 1 | IGHV3- 21 | IGLV3- 19 | CARDPPLSGSY AGEFDYW | 1434 | CNSRDSS GNHWVF | 1570 | 1706 | 1842 |
| clonotype 320 | 1 | IGHV2- 70 | IGLV3- 10 | CARRRGYSYGW GDFDYW | 1435 | CYSTDSS GNHRVF | 1571 | 1707 | 1843 |
| clonotype 322 | 1 | IGHV3- 48 | IGLV3- 10 | CARGGLLNWNY EGWFDPW | 1436 | CYSTDSS GNHRVF | 1572 | 1708 | 1844 |
| clonotype 323 | 1 | IGHV3- 11 | IGLV3- 10 | CARDGGIAARP DWYFDLW | 1437 | CYSTDSS GNHRVF | 1573 | 1709 | 1845 |
| clonotype 326 | 1 | IGHV3- 48 | IGLV1- 40 | CARTYYYGSGS YYTLDYW | 1438 | CQSYDSS LSGVVF | 1574 | 1710 | 1846 |
| clonotype 327 | 1 | IGHV1- 8 | IGLV5- 45 | CARGGITIFGV VTPFDYW | 1439 | CMIWHSS AWVF | 1575 | 1711 | 1847 |
| clonotype 328 | 1 | IGHV4- 30-4 | IGLV3- 1 | CARDALHYYGS GSAFDYW | 1440 | CQAWDSS TVVF | 1576 | 1712 | 1848 |
| clonotype 333 | 1 | IGHV3- 7 | IGLV3- 19 | CAREGVLWEGE FYYYMDVW | 1441 | CNSRDSS GNHLVF | 1577 | 1713 | 1849 |
| clonotype 339 | 1 | IGHV3- 48 | IGLV3- 10 | CARDGDYYDSS GYYHFDYW | 1442 | CYSTDSS GNHRVF | 1578 | 1714 | 1850 |
| clonotype 340 | 1 | IGHV3- 23 | IGLV3- 10 | CAKDRGGENWN YGGWFDPW | 1443 | CYSTDSS GNHRVF | 1579 | 1715 | 1851 |
| clonotype 341 | 1 | IGHV3- 33 | IGLV3- 21 | CAGAYYYDSSG YLNYMDVW | 1444 | CQVWDSS SDHPVF | 1580 | 1716 | 1852 |
| clonotype 342 | 1 | IGHV3- 15 | IGLV1- 44 | CTTDHIEYSSL YYFDYW | 1445 | CSSYAGS NNFVF | 1581 | 1717 | 1853 |
| clonotype 343 | 1 | IGHV1- 18 | IGLV2- 8 | CARQLAYCGGD CYLYFDYW | 1446 | CSSYAGS NNLVF | 1582 | 1718 | 1854 |
| clonotype 345 | 1 | IGHV6- 1 | IGLV2- 8 | CAREAYWNYGG FDYW | 1447 | CSSYAGS NNFGVF | 1583 | 1719 | 1855 |
| clonotype 349 | 1 | IGHV3- 21 | IGLV3- 1 | CARDGRITMVR GVRNWFDPW | 1448 | CQAWDSS TVVF | 1584 | 1720 | 1856 |
| clonotype 350 | 1 | IGHV-3 48 | IGLV3- 1 | CARMSSQLELH YYCYYMDVW | 1449 | CQAWDSS TVVF | 1585 | 1721 | 1857 |

TABLE 8-continued

VH-CDR3 and VL-CDR3 Sequences for EPOR/CD131 Binders

| clonotype_ id | fre- quency | VH Gene | VL Gene | VH-CDR3 AA | SEQ ID NO | VL-CDR3 AA | SEQ ID NO | Full HC AA Sequence SEQ ID NO | Full LC AA Sequence SEQ ID NO |
|---|---|---|---|---|---|---|---|---|---|
| clonotype 351 | 1 | IGHV3- 15 | IGLV3- 1 | CTTDLGYSGYD WGAFDYW | 1450 | CQAWDSS TVVF | 1586 | 1722 | 1858 |
| clonotype 352 | 1 | IGHV6- 1 | IGLV3- 1 | CARDRVNWNDV GFDYW | 1451 | CQAWDSS TVVF | 1587 | 1723 | 1859 |
| clonotype 356 | 1 | IGHV3- 7 | IGLV3- 10 | CARTPGYSSSW YEGPYFDYW | 1452 | CYSTDSS GNHVVF | 1588 | 1724 | 1860 |
| clonotype 358 | 1 | IGHV4- 39 | IGLV3- 10 | CAREDLIGNDY W | 1453 | CYSTDSS GNHRVF | 1589 | 1725 | 1861 |
| clonotype 359 | 1 | IGHV4- 39 | IGLV1- 44 | CAREDLIGNDY W | 1454 | CAAWDDS LKVF | 1590 | 1726 | 1862 |
| clonotype 360 | 1 | IGHV4- 34 | IGLV7- 43 | CAREGLTGHVF DIW | 1455 | CLLYYGG AQVF | 1591 | 1727 | 1863 |
| clonotype 361 | 1 | IGHV4- 34 | IGLV2- 23 | CAREGLTGHTF DIW | 1456 | CCSYAGS STVVF | 1592 | 1728 | 1864 |
| clonotype 363 | 1 | IGHV1- 18 | IGLV3- 27 | CARGVWGSYRS HSYYTFMDVW | 1457 | CFSAADN TSVF | 1593 | 1729 | 1865 |
| clonotype 364 | 1 | IGHV3- 21 | IGLV3- 19 | CARDYRPYYDI LTGYSHFDYW | 1458 | CNSRDSS GNHVVF | 1594 | 1730 | 1866 |
| clonotype 365 | 1 | IGHV1- 46 | IGLV3- 10 | CARRVLWFGEL RDYFYYMDVW | 1459 | CYSTDSS GNHVVF | 1595 | 1731 | 1867 |
| clonotype 366 | 1 | IGHV4- 30-4 | IGLV2- 8 | CVRQGYDSWTG YSFFYFDYW | 1460 | CSSYAGS NNLVF | 1596 | 1732 | 1868 |
| clonotype 367 | 1 | IGHV4- 34 | IGLV1- 44 | CARGGGYSFGG FDYW | 1461 | CTSWDDS LNTWVF | 1597 | 1733 | 1869 |
| clonotype 368 | 1 | IGHV4- 39 | IGLV3- 9 | CARQNWGSDAF DIW | 1462 | CQVWDSS TAVF | 1598 | 1734 | 1870 |
| clonotype 369 | 1 | IGHV4- 34 | IGLV3- 19 | CARGELGIGYW YFDLW | 1463 | CNSRDSS GNHVVF | 1599 | 1735 | 1871 |
| clonotype 370 | 1 | IGHV4- 34 | IGLV3- 10 | CAREGGTTHEP LFDYW | 1464 | CYSTDSS GNHRVF | 1600 | 1736 | 1872 |
| clonotype 379 | 1 | IGHV1- 18 | IGLV2- 23 | CARAPGGSCGS TNCYKWNYDPY YFDYW | 1465 | CCSYAGS STLVF | 1601 | 1737 | 1873 |
| clonotype 380 | 1 | IGHV1- 18 | IGLV2- 23 | CARAPGGDCSS TSCYKWNYDPY YFDYW | 1466 | CCSYAGS STLVF | 1602 | 1738 | 1874 |

TABLE 9

Full Heavy Chain (HC) and Light Chain (LC) Sequences for EPOR/CD131 Binders

| SEQ ID NO | Full HC AA Sequence | SEQ ID NO | Full LC AA Sequence |
|---|---|---|---|
| 1603 | QVQLVQSGAEVKKPGASVKVSCKASGYTFTS YDINWVRQATGQGLEWMGWMNPNSGNTGYAQ KFQGRVTMTRNTSISTAYMELSSLRSEDTAV YYCARWGRGFDPWGQGTLVTVSS | 1739 | SYELTQPPSVSVSPGQTASITCSGDKLGDKY ACWYQQKPGQSPVLVIYQDSKRPSGIPERFS GSNSGNTATLTISGTQAMDEADYYCQAWDSS TAVFGGGTKLTVL |

TABLE 9-continued

Full Heavy Chain (HC) and Light Chain (LC) Sequences for EPOR/CD131
Binders

| SEQ ID NO | Full HC AA Sequence | SEQ ID NO | Full LC AA Sequence |
|---|---|---|---|
| 1604 | QVQLVQSGAEVKKPGSSVKVSCKASGGTFSS YAISWVRQAPGQGLEWMGGIIPIFGTANYAQ KFQGRVTITADESTSTAYMELSSLRSEDTAV YYCARERLELRWFDPWGQGTLVTVSS | 1740 | QSALTQPASVSGSPGQSITISCTGTSSDVGG YNYVSWYQQHPGKAPKLMIYDVSKRPSGVSN RFSGSKSGNTASLTISGLQAEDEADYYCCSY AGSSTWVFGGGTKLTVL |
| 1605 | QLQLQESGPGLVKPSETLSLTCTVSGGSISS SSYYWGWIRQPPGKGLEWIGSIYYSGSTYYN PSLKSRVTISVDTSKNQFSLKLSSVTAADTA VYYCARQTDYWFDPWGQGTLVTVSS | 1741 | QSALTQPASVSGSPGQSITISCTGTSSDVGG YNYVSWYQQHPGKAPKLMIYDVSKRPSGVSN RFSGSKSGNTASLTISGLQAEDEADYYCCSY AGSSTLVFGGGTKLTVL |
| 1606 | EVQLVESGGGLVRPGGSLRLSCAASGFTFSS YSIHWVRQAPGKGLEWVSSISSSSTYIYYAD SLKGRFTISRDNAKNSLYLQMNSLRAEDTAV YYCAREGGIAVAGFDYWGQGTLVTVSS | 1742 | QSALTQPASVSGSPGQSITISCTGTSSDVGG YNYVSWYQQHPGKAPKLMIYEVSNRPSGVSN RFSGSKSGNTASLTISGLQAEDEADYYCSSY TSSSTLVFGGGTKLTVL |
| 1607 | EVQLVESGGGLVQPGGSLRLSCAASGFTFSS YDMHWVRQATGKGLEWVSAIGTAGDTYYPGS VKGRFTISRENAKNSLYLQMNSLRAGDTAVY YCARDSSSWYEDAFDIWGQGTMVTVSS | 1743 | SYELTQPLSVSVALGQTARITCGGNNIGSKN VHWYQQKPGQAPVLVIYRDSNRPSGIPERFS GSNSGNTATLTISRAQAGDEADYYCQVWDSS TVVFGGGTKLTVL |
| 1608 | EVQLVESGGGLVKPGGSLRLSCAASGFTFSD YYMSWVRQAPGKGLEWVSYISSSGSTIYYAD SVKGRFTISRDNAKNSLYLQMNSLRAEDTAV YYCAREETMVRGVIAYWGQGTLVTVSS | 1744 | QSALTQPASVSGSPGQSITISCTGTSSDVGG YNYVSWYQQHPGKAPKLMIYEVSNRPSGVSN RFSGSKSGNTASLTISGLQAEDEADYYCSSY TSSSTVVFGGGTKLTVL |
| 1609 | EVQLVESGGGLVKPGGSLRLSCAVSGFTFST DSMNWVRQAPGKGLEWVSSISGSSSYIYYTD SVKGRFTISRDNAKNSLFLQMNSLRAEDTAV YYCARDWGSFDLWGRGTLVTVSS | 1745 | SYELTQPPSVSVSPGQTARITCSGDALPKKY AYWYQQKSGQAPVLVIYEDSKRPSGIPERFS GSSSGTMATLTISGAQVEDEADYYCYSTDSS GNHWVFGGGTKLTVL |
| 1610 | EVQLVESGGGLIQPGGSLRLSCAASGFTVSS NYMSWVRQAPGKGLEWVSVIYSGGSTYYADS VKGRFTISRDNSKNTLYLQMNSLRAEDTAVY YCARDGGEYSSSYYFDYWGQGTLVTVSS | 1746 | QSALTQPPSASGSPGQSVTISCTGTSSDVGG YNYVSWYQQHPGKAPKLMIYEVSKRPSGVPD RFSGSKSGNTASLTVSGLQAEDEADYYCSSY AGSNNVVFGGGTKLTVL |
| 1611 | QLQLQESGPGLVKPSETLSLTCTVSGGSISS SSYYWGWIRQPPGKGLEWIGSIYYSGSTYYN PSLKSRVTISVDTSKNQFSLKLSSVTAADTA VYYCARHDPSFDYWGQGTLVTVSS | 1747 | LPVLTQPPSASALLGASIKLTCTLSSEHSTY TIEWYQQRPGRSPQYIMKVKSDGSHSKGDGI PDRFMGSSSGADRYLTFSNLQSDDEAEYHCG ESHTIDGQVGVVFGGGTKLTVL |
| 1612 | QVQLVQSGAEVKKPGASVKVSCKASGYTFTS YGISWVRQAPGQGLEWMGWISAYNGNTNYAQ KLQGRVTMTTDTSTSTAYMELRSLRSDDTAV YYCARERSNWDFDYWGQGTLVTVSS | 1748 | SYVLTQPPSVSVAPGKTARITCGGNNIGSKS VHWYQQKPGQAPVLVIYYDSDRPSGIPERFS GSNSGNTATLTISRVEAGDEADYYCQVWDSS SDHRVFGGGTKLTVL |
| 1613 | EVQLVESGGGLVQPGGSLRLSCAASGFTFSS YWMSWVRQAPGKGLEWVANIKQDGSEKYYVD SVKGRFTISRDNAKNSLYLQMNSLRAEDTAV YYCARDGGVRGVITYFDYWGQGTLVTVSS | 1749 | SYELTQPPSVSVSPGQTASITCSGDKLGDKY ACWYQQKPGQSPVLVIYQDSKRPSGIPERFS GSNSGNTATLTISGTQAMDEADYYCQAWDSS NVVFGGGTKLTVL |
| 1614 | QVQLVQSGAEVKKPGASVKVSCKASGYTFTS YDINWVRQATGQGLEWMGWMNPNSGNTGYAQ KFQGRVTMTRNTSISTAYMELSSLRSEDTAV YYCARGRGSSWYWYFDLWGRGTLVTVSS | 1750 | SYELTQPPSVSVSPGQTASITCSGDKLGDKY ACWYQQKPGQSPVLVIYQDSKRPSGIPERFS GSNSGNTATLTISGTQAMDEADYYCQAWDSS TAVFGGGTKLTVL |
| 1615 | EVQLVESGGGLVQPGGSLRLSCAASGFTFSS YDMHWVRQATGKGLEWVSAIGTAGDTYYPGS VKGRFTISRENAKNSLYLQMNSLRAGDTAVY YCARGSSSSAFDIWGQGTMVTVSS | 1751 | SYELTQPLSVSVALGQTARITCGGNNIGSKN VHWYQQKPGQAPVLVIYRDSNRPSGIPERFS GSNSGNTATLTISRAQAGDEADYYCQVWDSS TWVFGGGTKLTVL |
| 1616 | EVQLVESGGGLVKPGGSLRLSCAASGFTFSS YSMNWVRQAPGKGLEWVSSISSSSSYIYYAD SVKGRFTISRDNAKNSLYLQMNSLRAEDTAV YYCARDGGIAAAGTDYWGQGTLVTVSS | 1752 | SYELTQPSSVSVSPGQTARITCSGDVLAKKY ARWFQQKPGQAPVLVIYKDSERPSGIPERFS GSSSGTTVTLTISGAQVEDEADYYCYSAADN NLVFGGGTKLTVL |
| 1617 | EVQLVESGGGLVKPGGSLRLSCAASGFTFSS YSMNWVRQAPGKGLEWVSSISSSSSYIYYAD SVKGRFTISRDNAKNSLYLQMNSLRAEDTAV YYCARDSLTGGFFDYWGQGTLVTVSS | 1753 | SYELTQPPSVSVSPGQTARITCSGDALPKKY AYWYQQKSGQAPVLVIYEDSKRPSGIPERFS GSSSGTMATLTISGAQVEDEADYYCYSTDSS GNHSWVFGGGTKLTVL |
| 1618 | QVQLVQSESELKKPGASVKVSCKASGYTFIS YAMSWVRQAPGQGLEWMGWINTNTGNPTYAQ GFTGRFVFSLDTSVSTAYLQISSLKAEDTAV YYCAERGWNYDYWGQGTLVTVSS | 1754 | QAVVTQEPSLTVSPGGTVTLTCGSSTGAVTS GHYPYWFQQKPGQAPRTLIYDTSNKHSWTPA RFSGSLLGGKAALTLSGAQPEDEAEYYCLLS YSGAWVFGGGTKLTVL |

TABLE 9-continued

Full Heavy Chain (HC) and Light Chain (LC) Sequences for EPOR/CD131
Binders

| SEQ ID NO | Full HC AA Sequence | SEQ ID NO | Full LC AA Sequence |
|---|---|---|---|
| 1619 | EVQLVESGGGLIQPGGSLRLSCAASGFTVSS NYMSWVRQAPGKGLEWVSVIYSGGSTYYADS VKGRFTISRDNSKNTLYLQMNSLRAEDTAVY YCARDSTTVTLFDYWGQGTLVTVSS | 1755 | QSALTQPASVSGSPGQSITISCTGTSSDVGG YNYVSWYQQHPGKAPKLMIYEVSNRPSGVSN RFSGSKSGNTASLTISGLQAEDEADYYCSSY TSSSTYVFGTGTKVTVL |
| 1620 | EVQLVESGGGLVKPGGSLRLSCAASGFTFSS YSMNWVRQAPGKGLEWVSSISSSSSYIYYAD SVKGRFTISRDNAKNSLYLQMNSLRAEDTAV YYCARGIAVAGPHAFDIWGQGTMVTVSS | 1756 | QSALTQPPSASGSPGQSVTISCTGTSSDVGG YNYVSWYQQHPGKAPKLMIYEVSKRPSGVPD RFSGSKSGNTASLTVSGLQAEDEADYYCSSY AGSNNFVVFGGGTKLTVL |
| 1621 | EVQLVESGGGLIQPGGSLRLSCAASGFTVSS NYMSWVRQAPGKGLEWVSVIYSGGSTYYADS VKGRFTISRDNSKNTLYLQMNSLRAEDTAVY YCARGYSGSYAYWGQGTLVTVSS | 1757 | QSVLTQPPSVSGAPGQRVTISCTGSSSNIGA GYDVHWYQQLPGTAPKLLIYGNSNRPSGVPD RFSGSKSGTSASLAITGLQAEDEADYYCQSY DSSLSGYVFGTGTKVTVL |
| 1622 | QVQLQQSGPGLVKPSQTLSLTCAISGDSVSS NSAAWNWIRQSPSRGLEWLGRTYYRSKWYND YAGSVKSRIIINPDTSKNQLSLQLKSVTPED TAVYYCARKWELRDAFDIWGQGTMVTVSS | 1758 | QSALTQPASVSGSPGQSITISCTGTSSDVGG YNYVSWYQQHPGKAPKLMIYDVSKRPSGVSN RFSGSKSGNTASLTISGLQAEDEADYYCSSY AGRSTLGIDWVFGGGTKLTVL |
| 1623 | EVQLVQSGAVVKKPGESLKISCKGSGYSFSS YWIGWVRQMPGKGLEWMGIIYPGDSDTRYSP SFQGQVTISADKSISTAYLQWSSLQASDTAM YFCAKRRMTGSHSWFDPWGQGTLVTVSS | 1759 | SYVLTQPPSVSVAPGKTARITCEGDNIGSES VHWYQQKPGQAPVLVIYFDSDRPSGIPERFS GSNSGITATLTISRVEAGDEADFYCQVWDNG SDHVVFGGGTKLTVL |
| 1624 | EVQLVESGGGLVQPGGSLRLSCAASGFTFSS YWMHWVRQAPGKGLVWVSRINSDGSSTSYAD SVKGRFTISRDNAKNTLYLQMNSLRAEDTAV YYCARIDYWGQGTLVTVSS | 1760 | QSALTQPASVSGSPGQSITISCTGTSSDVGG YNYVSWYQQHPGKAPKLMIYEVSNRPSGVSN RFSGSKSGNTASLTISGLQAEDEADYYCSSY TSSSTWVFGGGTKLTVL |
| 1625 | EVQLVESGGGLVQPGGSLRLSCAASGFTFSS YWMSWVRQAPGKGLEWVANIKQDGSEKYYVD SVKGRFTISRDNAKNSLYLQMNSLRAEDTAV YYCARDGGTPGQGTLVTVSS | 1761 | SYELTQPPSVSVSPGQTARITCSGDALPKKY AYWYQQKSGQAPVLVIYEDSKRPSGIPERFS GSSSGTMATLTISGAQVEDEADYYCYSTDSS GNHRVFGGGTKLTVL |
| 1626 | QVQLQESGPGLVKPSETLSLTCTVSGGSISS YYWSWIRQPPGKGLEWIGYIYYSGSTNYNPS LKSRVTISVDTSKNQFSLKLSSVTAADTAVY YCAIVGARFDYWGQGTLVTVSS | 1762 | SYELTQPSSVSVSPGQTARITCSGDVLAKKY ARWFQQKPGQAPVLVIYKDSERPSGIPERFS GSSSGTTVTLTISGAQVEDEADYYCYSAADN NLVFGGGTKLTVL |
| 1627 | EVQLVESGGGLVKPGGSLRLSCAASGFTFIN AWMSWVRQAPGKGLEWVGRIKSKTDGGTTDY AAPVKGRFTISRDDSKNTLYLQMNSLKTEDT AVYYCTTGGTHWGQGTLVTVSS | 1763 | SYELTQPPSVSVSPGQTARITCSADALPNQY AYWYQQKPGQAPVLVIYKDSERPSGIPERFS GSSSGTTVTLTISGVQAEDEADYYCQSADSS GTWVFGGGTKLTVL |
| 1628 | EVQLVESGGGLVKPGGSLRLSCAASGFTFSN AWMSWVRQAPGKGLEWVGRIKSKTDGGTTDY AAPVKGRFTISRDDSKNTLYLQMNSLKTEDT AVYYCTTGGYRWGQGTLVTVSS | 1764 | SYELTQPPSVSVSPGQTARITCSADALSKQY AYWYQQKPGQAPVLVIYKDSERPSGIPERFS GSSSGTTVTLTISGVQAEDEADYYCQSADSS GTNWVFGGGTKLTVL |
| 1629 | EVQLVESGGGLVKPGGSLRLSCAASGFTFSN AWMSWVRQAPGKGLEWVGRIKSKTDGGTTDY AAPVKGRFTISRDDSKNTLYLQMNSLKTEDT AVYYCTTDLYYWGQGTLVTVSS | 1765 | SYELTQPPSVSVSPGQTARITCSGDALPKKY AYWYQQKSGQAPVLVIYEDSKRPSGIPERFS GSSSGTMATLTISGAQVEDEADYYCYSTDSS GNHRVFGGGTKLTVL |
| 1630 | QVQLVQSGAEVKKPGASVKVSCKASGYTFTS YGISWVRQAPGQGLEWMGWISAYNGNTNYAQ KLQGRVTMTTDTSTSTAYMELRSLRSDDTAV YYCARGWYFDYWGQGTLVTVSS | 1766 | QSALTQPASVSGSPGQSITISCTGTSSDVGG YNYVSWYQQHPGKAPKLMIYEVSNRPSGVSN RFSGSKSGNTASLTISGLQAEDEADYYCSSY TSSSTLVFGGGTKLTVL |
| 1631 | EVQLVESGGGLVQPGGSLRLSCAASGFTFST YAMNWVRQAPGKGLEWVSAISGGGGSTYYAD SVKGRFTISRDNSKNTLYLQMNSLRAEDTAV YYCAKRVFFDYWGQGTLVTVSS | 1767 | QSALTQPASVSGSPGQSITISCTGTSSDVGG YNYVSWYQQHPGKAPKLMIYEVSNRPSGVSN RFSGSKSGNTASLTISGLQAEDEADYSCSSY TISSTWVFGGGTKLTVL |
| 1632 | EVQLVESGGGLVQPGGSLRLSCAASGFTFSS YDMHWVRQATGKGLEWVSAIGTAGDTYYPGS VKGRFTISRENAKNSLYLQMNSLRAGDTAVY YCARDLGRVFDYWGQGTLVTVSS | 1768 | SYELTQPPSVSVSPGQTARITCSGDALPKKY AYWYQQKSGQAPVLVIYEDSKRPSGIPERFS GSSSGTMATLTISGAQVEDEADYYCYSTDSS GNHRVFGGGTKLTVL |

TABLE 9-continued

Full Heavy Chain (HC) and Light Chain (LC) Sequences for EPOR/CD131
Binders

| SEQ ID NO | Full HC AA Sequence | SEQ ID NO | Full LC AA Sequence |
|---|---|---|---|
| 1633 | VVQLVESGGGLVQPGGSLRLSCAASGFTFSR YWMSWVRQAPGKGLEWVANINQDGSEEYYVD SVKGRFTISRDNAKSSLSLQMNSLRAEDTAL YYCATDLNWNGYWGQGTLVTVSS | 1769 | QSALTQPASVSGSPGQSITISCTGTSSDVGG YDYVSWYQQHPGKAPKFMISGVSNRPSGVSN RFSGSKSGNTASLTISGLQAEDEADYYCSSY TRSRTWVFGGGTKLTVL |
| 1634 | EVQLVESGGGLVQPGGSLRLSCAASGFTFSR CDMYWVRQATGKGLEWVSAIGAAGDTYYPGS VKGRFTISRENAKNSLYLQMNSLRAGDTAVY YCATGYNWNPDYWGQGTLVTVSS | 1770 | QAVLTQPASLSASPGASASLTCTLRSGINVG TYRIYWYQQKPGSPPQYLLRYKSDSDKQQGS GVPSRFSGSKDASANAGILLISGLQSEDEAD YYCMIWHSSASVFGGGTKLTVL |
| 1635 | QVQLVESGGGVVQPGRSLRLSCEASGFTFIN YGMHWVRQAPGKGLEWVAVIWYDGSNKYYAD SVKGRFTISRDNSKNTLYLQMNSLRAEDTAV YYCARDRSSSSDYWGQGTLVIVSS | 1771 | SYELTQPSSVSVSPGQTARITCSGDVLAKKY ARWFQQKPGQAPVLVIYKDSERPSGIPERFS GSSSGTTVTLTISGAQVEDEADYYCYSAADN NRVFGGGTKLTVL |
| 1636 | EVQLVESGGGLVQPGGSLRLSCAASGFTFSS YWMHWVRQAPGKGLVWVSRINSDGSSTSYAD SVKGRFTISRDNAKNTLYLQMNSLRAEDTAV YYCAGITGTYFDYWGQGTLVTVSS | 1772 | SYELTQPSSVSVSPGQTARITCSGDVLAKKY ARWFQQKPGQAPVLVIYKDSERPSGIPERFS GSSSGTTVTLTISGAQVEDEADYYCYSAADN NLVFGGGTKLTVL |
| 1637 | EVQLVESGGGLVQPGRSLRLSCAASGFTFDD YAMHWVRQAPGKGLEWVSGISWNSGSIGYAD SVKGRFTISRDNAKNSLYLQMNSLRAEDTAL YYCAKDSGYSPDYWGQGTLVTVSS | 1773 | SYELTQPPSVSVSPGQTARITCSGDALPKKY AYWYQQKSGQAPVLVIYEDSKRPSGIPERFS GSSSGTMATLTISGAQVEDEADYYCYSTDSS GKGVFGGGTKLTVL |
| 1638 | QVQLVQSGAEVKKPGASVKVSCKASGYTFTS YGISWVRQAPGQGLEWMGWISAYNGNTNYAQ KLQGRVTMTTDTSTSTAYMELRSLRSDDTAV YYCARDRPYYFDYWGQGTLVTVSS | 1774 | SYELTQPPSVSVSPGQTARITCSGDALPKKY AYWYQQKSGQAPVLVIYEDSKRPSGIPERFS GSSSGTMATLTISGAQVEDEADYYCYSTDSS GNHRVFGGGTKLTVL |
| 1639 | QVQVVQSGAEVRKSGASVKVSCKASGYTFTS YYIHWVRQVPGQGLEWMGLINPSGGSTIYAQ KFQGRVTMTRDTSTSVYMELSSLRSEDTAA YYCARGGWGTMDVWGKGTTVTVSS | 1775 | SSELTQDPAVSVALGQTVRITCQGDSLRSYY ASWYQQKPGQAPVLVIYGKNNRPSGIPDRES GSSSGNTASLTITGAQAEDEADYYCNSRDSS GNHYVFGTGTKVTVL |
| 1640 | EVQLVESGGGLVQPGGSLRLSCAASGFTFSS YDMHWVRQATGKGLEWVSAIGTAGDTYYPGS VKGRFTISRENAKNSLYLQMNSLRAGDTAVY YCARAWELDAFDIWGQGTMVTVSS | 1776 | SSELTQDPAVSVALGQTVRITCQGDSLRSYY ASWYQQKPGQAPVLVIYGKNNRPSGIPDRES GSSSGNTASLTITGAQAEDEADYYCNSRDSS GNHVVFGGGTKLTVL |
| 1641 | EVQLVESGGGLVQPGGSLRLSCAASGFTFSS YAMSWVRQAPGKGLEWVSAISGSGGSTYYAD SVKGRFTISRDNSKNTLYLQMNSLRAEDTAV YYCAKDNWNYFDYWGQGTLVTVSS | 1777 | SYELTQPPSVSVSPGQTARITCSGDALPKKY AYWYQQKSGQAPVLVIYEDSKRPSGIPERFS GSSSGTMATLTISGAQVEDEADYYCYSTDSS GNHRVFGGGTKLTVL |
| 1642 | QVQLVESGGGVVQPGRSLRLSCAASGFTFSS YGMHWVRQAPGKGLEWVAVIWYDGSNKYYAD SVKGRFTISRDNSKNTLYLQMNSLRAEDTAV YYCARVYNWIFDYWGQGTLVTVSS | 1778 | SYELTQPPSVSVSPGQTARITCSGDALPKKY AYWYQQKSGQAPVLVIYEDSKRPSGIPERFS GSSSGTMATLTISGAQVEDEADYYCYSTDSS GNHRVFGGGTKLTVL |
| 1643 | EVQVMESGGGLVKPGGSLRLSCAASGFSFSS HSLNWVRQAPGKGLEWVSSISGISNYIAYAD SVRGRFTISRDNAKNSLFLQMNSLRAEDTGV YYCARITVVSFDYWGQGTLVTVTS | 1779 | QSALTQPASVSGSPGQSITISCTGTNNDVGY YNYVSWYQQHPDKAPKLMIYDVIKRPSGVSD RFSGSKSGNTASLTISGLQAEDEADYYCCSY AGSSTWVFGGGTKLSVL |
| 1644 | EVQLVESGGGLVQPGGSLRLSCAASGFTFSS YAMSWVRQAPGKGLEWVSAISGSGGNTYNAD SVKGRFTISRDNSKNTLYLQMNSLRAEDTAV YYCAKAAGKGDYWGQGTLVTVSS | 1780 | QSALTQPPSASGSPGQSVTISCTGTSSDVGG YNYVSWYQQHPGKAPKLMIYEVSKRPSGVPD RFSGSKSGNTASLTVSGLQAEDEADYYCSSY SGSNNYVFGTGTKVTVL |
| 1645 | QVQLVQSGAEVKKPGASVKVSCKASGYTFTS YYIHWVRQAPGQGLEWMGIINPSGGTTNYAQ KFQGRVTMTRDTSTSTVYMELSSLRSEDTAV YYCARGDWGTMDVWGKGTTVTVSS | 1781 | QSALTQPASVSGSPGQSITISCTGTSSDVGN YNYVSWYQQHPGKVPKLMIYEVIYRPSGVSN RFSGSKSGNTASLTISGLQAEDEADYYCTSY TRNNTYVFGSGTKVTVL |
| 1646 | EVQLVESGGGLVQPGGSLRLSCAASGFTFSS YWMSWVRQAPGKGLEWVANIKQDGSEKYYVD SVKGRFTISRDNAKNSLYLQMNSLRAEDTAV YYCARDGTGWFDPWGQGTLVTVSS | 1782 | QSVLTQPPSVSGAPGQRVTISCTGSSSNIGA GYDVHWYQQLPGTAPKLLIYGNSNRPSGVPD RFSGSKSGTSASLAITGLQAEDEADYYCQSY DSSLSGWVFGGGTKLTVL |
| 1647 | QVQLVQSGAEVKKPGASVKVSCKASGYTFTS YGISWVRQAPGQGLEWMGWISAYNGNTNYAQ KLQGRVTMTTDTSTSTAYMELRSLRSDDTAV YYCARRGTVVFDYWGQGTLVTVSS | 1783 | QSALTQPASVSGSPGQSITISCTGTSSDVGG YNYVSWYQQHPGKAPKLMIYDVSKRPSGVSN RFSGSKSGNTASLTISGLQAEDEADYYCCSY AGSSTYVVFGGGTKLTVL |

TABLE 9-continued

Full Heavy Chain (HC) and Light Chain (LC) Sequences for EPOR/CD131
Binders

| SEQ ID NO | Full HC AA Sequence | SEQ ID NO | Full LC AA Sequence |
|---|---|---|---|
| 1648 | QVQLVQSGAEVKKPGASVKVSCKASGYTFTN YGISWVRQAPGQGLEWMGWISAYNGNTNYAQ NLQGRVTMTTDTSTSTAYMELRSLRSDDTAV YYCARPLSGTLDNWGQGTLVTVSS | 1784 | QSALTQPASVSGSPGQSITISCTGTSSDVGG YNYVSWYQQHPGKAPKLMIYDVSKRPSGVSN RFSGSKSGNTASLTISGLQAEDEADYYCCSY AGRSTLGIDWVFGGGTKLTVR |
| 1649 | EVQLVESGGGLVQPGGSLRLSCAASGFTFSS YSMNWVRQAPGKGLEWVSYISSSSSTIYYAD SVKGRFTISRDNAKNSLYLQMNSPRDEDTAV YYCARESIAALFDYWGQGTLVTVSS | 1785 | SSELTQDPAVSVALGQTVRITCQGDSLRSYY ASWYQQKPGQAPVLVIYGKNNRPSGIPDRES GSSSGNTASLTITGAQAEDEADYYCNSRDSS GNHLVFGGGTKLTVL |
| 1650 | EVQLVESGGGLVQPGGSLRLSCAASGFTFSS YDMHWVRQATGKGLEWVSAIGTAGDTYYPGS VKGRFTISRENAKNSLYLQMNSLRAGDTAVY YCARGDHSYGGLDYWGQGTLVTVSS | 1786 | SYELTQPPSVSVSLGQMARITCSGEALPKKY AYWYQQKPGQFPVLVIYKDSERPSGIPERFS GSSSGTIVTLTISGVQAEDEADYYCLSADSS GTYRVFGGGTKLTVL |
| 1651 | QVQLVQSGAEVEKPGASVKVSCKASGYTFTS YDIYWVRQATGQGLEWMGWMIPNSGNTGYAQ RFEDRVTMTRSTSMNTAYMELNSLRSEDTAV YYCARGDWAWSFDLWGRGTLVTVSS | 1787 | QSALTQPASVSGSPGQSITISCTGTSSDVGG YNYVSWYQQHPGKAPKLMIYEVSHRPSGVSN RFSGSKSGNTASLTISGLQAEDESDYYCSSY TSSSSLVFGGGTKLTVL |
| 1652 | QVQLVQSGAEVKKPGASVKVSCKASGYTFTS YYMHWVRQAPGQGLEWMGIINPSGGSTSYAQ KFQGRVTMTRDTSTSTVYMELSSLRSEDTAV YYCARGLRRDWFDPWGQGTLVTVSS | 1788 | QSALTQPASVSGSPGQSITISCTGTSSDVGG YNYVSWYQQHPGKAPKLMIYEVSNRPSGVSN RFSGSKSGNTASLTISGLQAEDEADYYCSSY TSSSTWVFGGGTKLTVL |
| 1653 | EVQLVESGGGLVKPGGSLRLSCAASGFTFSN AWMSWVRQAPGKGLEWVGRIKSKTDGGTTDY AAPVKGRFTISRDDSKNTLYLQMNSLKTEDT AVYYCTTGTGRSDYWGQGTLVTVSS | 1789 | QSALTQPRSVSGSPGQSVTISCTGTSSDVGG YNYVSWYQQHPGKAPKLMIYDVTTRPSGVPD RFSGSKSGNTASLTISGLQAEDEADYYCCSY SGSYTYVFGTGTKVTVL |
| 1654 | QVQLVESGGGVVQPGRSLRLSCAASGFTFSN YGMHWVRQAPGKGLDWVAVIWYDGNNEYYAD SVKDRFTISRDNSQNTLYLQMNSLRAEDRAV YYCVRGGVGDGFDMWGQGTMVTVSS | 1790 | QSALTQPASVSGSPGQSITISCTGTSSDVGG YNYVSWYQQHPGKVPKLMIYEVSNRPSGVSN RFSGSKSGNTASLTISGLQAEDEADYYCISY TNTNTRVFGGGTKLTVL |
| 1655 | QVQLVESGGGVVQPGRSLRLSCAASGFTFSS YGMHWVRQAPGKGLEWVAVIWYDGSNKYYAD SVKGRFTISRDNSKNTLYLQMNSLRAEDTAV YYCASVGSYGYFQHWGQGTLVTVSS | 1791 | QSALTQPASVSGSPGQSITISCTGTSSDVGG YNYVSWYQQHPGKAPKLMIYEVSNRPSGVSN RFSGSKSGNTASLTISGLQAEDEADYYCSSY TSSSTWVFGGGTKLTVL |
| 1656 | EVQLVESGGGVVRPGGSLRLSCAASGFTFDD YGMSWVRQAPGKGLEWVSGINWNGGSTGYAD SVKGRFTISRDNAKNSLYLQMNSLRAEDTAL YYCARKGNWNSFDYWGQGTLVTVSS | 1792 | QSALTQPPSASGSPGQSVTISCTGTSSDVGG YNYVSWYQQHPGKAPKLMIYEVSKRPSGVPD RFSGSKSGNTASLTVSGLQAEDEADYYCSSY AGSNNWVFGGGTKLTVL |
| 1657 | EVQLVESGGGLVKPGGSLRLSCAASGFTFSS YSMNWVRQAPGKGLEWVSSISSSSSYIYYAD SVKGRFTISRDNAKNSLYLQMNSLRAEDTAV YYCARDSAYYTFDYWGQGTLVTVSS | 1793 | QSALTQPPSASGSPGQSVTISCTGTSSDVGG YNYVSWYQQHPGKAPKLMIYEVSKRPSGVPD RFSGSKSGNTASLTVSGLQAEDEADYYCSSY AGSNNFWVFGGGTKLTVL |
| 1658 | EVQLVESGGGLVQPGGSLRLSCAASGFTFSS YAMSWVRQAPGKGLEWVSAISGSGGSTYYAD SVKGRFTISRDNSKNTLYLQMNSLRAEDTAV YYCGSGWYEGAFDYWGQGTLVTVSS | 1794 | QSALTQPASVSGSPGQSITISCTGTSSDVGG YNYVSWYQQHPGKAPKLMIYEVSNRPSGVSN RFSGSKSGNTASLTISGLQAEDEADYYCSSY TSSSTYWVFGGGTKLTVL |
| 1659 | EVQLVESGGGLVQPGGSLRLSCAASGFTFSS YDMHWVRQATGKGLEWVSAIGTAGDTYYPGS VKGRFTISRENAKNSLYLQMNSLRAGDTAVY YCARDRDSSHDAFDIWGQGTMVTVSS | 1795 | SYELTQPPSVSVSPGQTASITCSGDKLGDKY ACWYQQKPGQSPVLVIYQDSKRPSGIPERFS GSNSGNTATLTISGTQAMDEADYYCQAWDSS TVVFGGGTKLTVL |
| 1660 | EVQLVESGGGVVRPGGSLRLSCAASGFPFDD FGLNWVRQAPGKGLEWVSGINWNGGTTTYAD SVKGRFTISRDNAKKSLYLQMSSLRVEDTAL FYCVRDEIWNYYFDYWGQGTLVTVSS | 1796 | SYELTQPSSVSVSPGQTARITCSGDVLAKKY ARWFQQKPGQAPVLVIYKDSERPSGIPERFS GSSSGTTVTLTISGAQVEDEADYYCYSAADN NRVFGGGTKLTVL |
| 1661 | EVQMVESGGGRVKPGGSLRLSCTASGFSISI NNMNWVRQAPGKGLEWVSSISSSSTYIYYAD SVKGRFTISRDNAENSLYLQMNSLRAEDTGV YYCARDSYDFHAFDIWGQGTMVTVSS | 1797 | SYELTQPPSVSVSPGQTARITCSGDALPKKY AYWYQQKSGQAPVLVIYEDSKRPSGIPERFS GSSSGTMATLTISGAQVEDEADYYCYSTDSS GNHRVFGGGTKLTVL |

TABLE 9-continued

Full Heavy Chain (HC) and Light Chain (LC) Sequences for EPOR/CD131
Binders

| SEQ ID NO | Full HC AA Sequence | SEQ ID NO | Full LC AA Sequence |
|---|---|---|---|
| 1662 | EVQLVESGGGLVQPGGSLRLSCAASGFTFSS YWMHWVRQAPGKGLVWVSRINSDGSSTSYAD SVKGRFTISRDNAKNTLYLQMNSLRAEDTAV YYCARVGWGGHAFDIWGQGTMVTVSS | 1798 | SSELTQDPAVSVALGQTVRITCQGDSLRSYY ASWYQQKPGQAPVLVIYGKNNRPSGIPDRES GSSSGNTASLTITGAQAEDEADYYCNSRDSS GNHVVFGGGTKLTVL |
| 1663 | EVQLVESGGGLVKPGGSLRLSCAASGFTFST YSMNWVRQAPGKGLEWVSSISSSSTYIYYAD SVKGRFTISRDNAKNSLYLQMNSLRAEDTAV YYCARGYNWNYVGDYWGQGTLVTVSS | 1799 | QSALTQPASVSGSPGQSITISCTGTSSDVGG YNYVSWYQQHPGKAPKLMIYEVSNRPSGVSN RFSGSKSGNTASLTISGLQAEDEADYYCSSY TSSSTLVFGGGTKLTVL |
| 1664 | EVQLVESGGGLVQPGGSLRLSCAASGFTFSS YAMSWVRQAPGKGLEWVSAISGSGGSTYYAD SVKGRFTISRDNSKNTLYLQMNSLRAEDTAV YYCAKDANWGYAFDIWGQGTMVTVSS | 1800 | QSVLTQPPSVSGAPGQRVTISCTGSSSNIGA GYDVHWYQQLPGTAPKLLIYGNSNRPSGVPD RFSGSKSGTSASLAITGLQAEDEADYYCQSY DSSLSGSVFGGGTKLTVL |
| 1665 | QVQLVQSVSEVNKPGASVKVSCKASGYTFTT YGISWVRQAPGQGLEWMGWISGYSGYTSYAQ KFQGRLTMTTDTSANTAYMELRSLRSDDTAV YYCARRFIWNYGDFDYWGQGTLVTVSS | 1801 | SYELTQPPSVSVSPGQTASITCSRDKLGDKY ACWYQQKPGQSPVLVIYQDSKRPSGIPERFS GSNSGNTATLTISGTQAMDEADYYCQAWDSS TVVFGGGTKLTVL |
| 1666 | EVQLVESGGDLVQPGGSLRLSCAASGFTFSS YSMNWVRQAPGKGLEWVSYISRSSGTIYYAD SVKGRFTISRDNAKNSLYLQMNSLRDEDTAV YYCARGRLGIEDYFDYWGQGTLVTVSS | 1802 | SYELTQPPSVSVSPGQTASITCSGDKLGDRY ACWYQQKPGQSPVLVIYQGSKRPSGIPERFS GSNSGNTATLTISGTQAMDEADYYCQAWDSS TVVFGGGTKLTVL |
| 1667 | EVQLVESGGGLVQPGGSLRLSCAASGFTFNR YNMNWVRQAPGKGLEWVSYISSSSDTIYYAD SVKGRFTISRDNAKNSLYLQMNSLRDEDTAM YYCARECYSSSWAFDYWGQGTLVTVSS | 1803 | SSELTQDPAVSVALGQTVRITCQGDSLRSYY ASWYQQKPGQAPVLVIYGKNNRPSGILDRES GSSSGNTASLTITGAQAEDEGDYYCNSRDSS GWVFGGGTKLTVL |
| 1668 | QVQLQESGPGLVKPSGTLSLTCAISGGSISS SNWWSWVRQPPGKGLEWIGEIYHSGSTNFNP SLKSRVTISVDKSKNQFSLHLSSVTAADTAV YYCARDVGVDGRGFDYWGQGIVVIVSS | 1804 | SYELTQPPSVSVSPGQTANITCSGDKLENKY TCWYQQKPGQSPLVVIYQDNKRPSGIPERFS GSNSGNTATLTISGTQAMDEADYYCQAWDST TAWVFGGGTKLTVL |
| 1669 | EVQLVESGGGLVQPGGSLRLSCGVSGFTFSI YWMSWVRQAPGKGLEWVANINLDGSEKYHVD SVKGRFTISRDNAKNSLFLQMTSLRAEDTAV YYCARDILWSGGYLDVWGKGTTVTVSS | 1805 | SSELTQDPAVSVALGQTVRITCQGDNIRNYY ASWYQQKPGQAPLLVISGKNNRPSGIPDRES GSSSGNTASLTITGAQAEDEAYYYCYSRDSS GSLWIFGGGTKLTVL |
| 1670 | EVQLVESGGGLVQPGGSLRLSCAASGFTFSG YWMTWVRQAPGKGLEWVANIKHDGSEKYYVD SVKGRFTISRDNAQNSLYLQMNSLRAEDTAV YYCARKQLWLNWYFDFWGRGILVTVSS | 1806 | SSELTQDPAVSVALGQTVRITCQGDSLRRYY ASWYQQKPGQAPVLVIYGKDNRPSGIPDRES GSSSGNTASLTITGTQAEDEADYYCNSRDSS GNHLVFGGGTKLTVL |
| 1671 | QVQLVQSGAEVKKPGASVKVSCKASGYTFTT YGISWVRQAPGQGLEWMGWISAFNGNTNYAQ NLQGRVTMTTDTSTSTAYMELRSLRSDDTAV YYCARENNWNYGWFDPWGQGTLVTVSS | 1807 | SSELTQDPAVSVALGQTVRITCQGDSLRSYY ASWYQQKPGQAPVLVIYGKNNRPSGIPDRES GSSSGNTASLTITGAQAEDEADYYCNSRDSS GNHYVFGTGTKVTVL |
| 1672 | EVQLVESGGGLVQPGGSLRLSCAASGFTFSS YDMHWVRQATGKGLEWVSAIGTAGDTYYPGS VKGRFTISRENAKNSLYLQMNSLRAGDTAVY YCAREGYGDYPLPMDVWGKGTTVTVSS | 1808 | SYELTQPPSVSVSPGQTARITCSGDALPKKY AYWYQQKPGQAPVLVIYEDSKRPSGIPERFS GSSSGTMATLTISGAQVEDEADYYCYSTDSS GNHRVFGGGTKLTVL |
| 1673 | EVQLVESGGGLVKPGGSLRLSCAASGFTFSN AWMSWVRQAPGKGLEWVGRIKSKTDGGTTDY AAPVKGRFTISRDDSKNTLYLQMNSLKTEDT AVYYCTTDNWNSYFDYWGQGTLVTVSS | 1809 | SYELTQPPSVSVSPGQTARITCSGDALPKKY AYWYQQKSGQAPVLVIYEDSKRPSGIPERFS GSSSGTMATLTISGAQVEDEADYYCYSTDSS GNHRVFGGGTKLTVL |
| 1674 | EVQLVESGGGLVQPGGSLRLSCAASGFTFSS YAMSWVRQAPGKGLEWVSAISGGGGSTYYAD SVKGRFTISRDNSKNTLYLQMNSLRAEDTAV YYCAGNSGYDSPYFDYWGQGTLVTVSS | 1810 | SYELTQPPSVSVSPGQTARITCSGDALPKKY AYWYQQKSGQAPVLVIYEDSKRPSGIPERFS GSSSGTMATLTISGAQVEDEADYYCYSTDSS GNHRVFGGGTKLTVL |
| 1675 | QVQLVESGGGVVQPGRSLRLSCAASGFTFSS YGMHWVRQAPGKGLEWVAVIWYDGSNKYYAD SVKGRFTISRDNSKNTLYLQMNSLRAEDTAV YYCAREYSSSSDWFDPWGQGTLVTVSS | 1811 | SYELTQPPSVSVSPGQTARITCSGDALPKKY AYWYQQKSGQAPVLVIYEDIKRPSGIPERFS GSSSGTMATLTISGAQVEDEADYYCYSTDSS GNHRVFGGGTKLTVL |
| 1676 | EVQLVESGGGLVKPGGSLRLSCAASGFTFSS YSMNWVRQAPGKGLEWVSSISSSSSYIYYAD SVKGRFTISRDNAKNSLYLQMNSLRAEDTAV YYCARDGGITGRYFDLWGRGTLVTVSS | 1812 | QSALTQPRSVSGSPGQSVTISCTGTSSDVGG YNYVSWYQQHPGKAPKLMIYDVSKRPSGVPD RFSGSKSGNTASLTISGLQAEDEADYYCCSY AGSYTWVFGGGTKLTVL |

TABLE 9-continued

Full Heavy Chain (HC) and Light Chain (LC) Sequences for EPOR/CD131
Binders

| SEQ ID NO | Full HC AA Sequence | SEQ ID NO | Full LC AA Sequence |
|---|---|---|---|
| 1677 | EVQLVESGGGLVKPGGSLRLSCAASGFTFSS YSMNWVRQAPGKGLEWVSSISSSSSYIYYAD SVKGRFTISRDNAKNSLYLQMNSLRAEDTAV YYCAREGNWGPYYFDYWGQGTLVTVSS | 1813 | QSALTQPASVSGSPGQSITISCTGTSSDVGG YNYVSWYQQHPGKAPKLMIYDVSKRPSGVSN RFSGSKSGNTASLTISGLQAEDEADYYCCSY AGSSTVVFGGGTKLTVL |
| 1678 | QVQLVQSGAEVKKPGASVKVSCKASGYTFTG YYMHWVRQAPGQGLEWMGWINPNSGGTNYAQ KFQGRVTMTRDTSISTAYMELSRLRSDDTAV YYCARGVWSGYYTFDPWGQGTLVTVSS | 1814 | QSALTQPPSASGSPGQSVTISCTGTSSDVGG YNYVSWYQQHPGKAPKLMIYEVSKRPSGVPD RFSGSKSGNTASLTVSGLQAEDEADYYCSSY AGSNNWVFGGGTKLTVL |
| 1679 | EVQLVESGGGLVKPGGSLRLSCAASGFTFSN AWMSWVRQAPGKGLEWVGRIKSKTDGGTTDY AAPVKGRFTISRDDSKNTLYLQMNSLKTEDT AVYYCTPHSSSPVFDYWGQGTLVTVSS | 1815 | QSALTQPASVSGSPGQSITISCTGTSSDVGG YNYVSWYQQHPGKAPKLMIYEVSNRPSGVSN RFSGSKSGNTASLTISGLQAEDEADYYCSSY TSSSHVVFGGGTKLTVL |
| 1680 | QVQLVQSGAEVKKPGASVKVSCKASGYTFTG YYMHWVRQAPGQGLEWMGWINPNSGGTNYAQ KFQGRVTMTRDTSISTAYMELSRLRSDDTAV YYCARDDTGTTGGYFQHWGQGTLVTVSS | 1816 | SYELTQPPSVSVSPGQTASITCSGDKLGDKY ACWYQQKPGQSPVLVIYQDSKRPSGIPERFS GSNSGNTATLTISGTQAMDEADYYCQAWDSS TVVFGGGTKLTVL |
| 1681 | QVQLVQSGAEVKKPGASVKVSCKASGYTFTS YDINWVRQATGQGLEWMGWMNPNSGNTGYAQ KFQGRVTMTRNTSISTAYMELSSLRSEDTAV YYCARAVAVAGTGWFDPWGQGTLVTVSS | 1817 | SYELTQPPSVSVSPGQTASITCSGDKLGDKY ACWYQQKPGQSPVLVIYQDSKRPSGIPERFS GSNSGNTATLTISGTQAMDEADYYCQAWDSS TVVFGGGTKLTVL |
| 1682 | EVQLVESGGGLVKPGGSLRLSCAASGFTFSN AWMSWVRQAPGKGLEWVGRIKSKTDGGTTDY AAPVKGRFTISRDDSKNTLYLQMNSLKTEDT AVYYCTTNYGDYVGFDYWGQGTLVTVSS | 1818 | SYELTQPSSVSVSPGQTARITCSGDVLAKKY ARWFQQKPGQAPVLVIYKDSERPSGIPERFS GSSSGTTVTLTISGAQVEDEADYYCYSAADN NLVFGGGTKLTVL |
| 1683 | EVHLVESGGGLVQPGGSLRLSCAASGFTFSG YWMSWVRQAPGKGLEWVANIKQDGSDKYYVD SVKGRFTISRDNAINSLFLQLTSLRAEDTAV YYCAREIDWNYGFHFDYWGQGTLITVSS | 1819 | SYELTQPPSVSVSPGQTARITCSGDALPQKY AFWYQQKSGQAPVLVIYEDSERPSGIPERFS GSTSGTMATLTISGAQVEDEADYYCESTDSS GNKVFGGGTKLTVL |
| 1684 | QVQLVQSGAEVKKPGASVKVSCKASGYTFTS YDINWVRQATGQGLEWMGWMNPNSGNTGYAQ KFQGRVTMTRNTSISTAYMELSSLRSEDTAV YYCARGYYDFWSGPFDYWGQGTLVTVSS | 1820 | SYELTQPPSVSVSPGQTARITCSGDALPKKY AYWYQQKSGQAPVLVIYEDSKRPSGIPERFS GSSSGTMATLTISGAQVEDEADYYCYSTDSS GNRVFGGGTKLTVL |
| 1685 | QVQLVESGGGVVQPGRSLRLSCAASGFTFSS YGMHWVRQAPGKGLEWVAVIWYDGSNKYYAD SVKGRFTISRDNSKNTLYLQMNSLRAEDTAV YYCARDSKWELLNWFDPWGQGTLVTVSS | 1821 | SYELTQPPSVSVSPGQTARITCSGDALPKKY AYWYQQKSGQAPVLVIYEDSKRPSGIPERFS GSSSGTMATLTISGAQVEDEADYYCYSTDSS GNRVFGGGTKLTVL |
| 1686 | QVQLQESGPGLVKPSETLSLTCTVSGGSISD YYWNWIRQPPGKGLEWIGYISSRGRTNYNPS LKSRVTLSVDSSKNQFSLKLTSVTAADTAVE YCARGRHFDWLLSYFDYWGQGTLVTVSS | 1822 | SSELTQDPAVSVALGQTVRITCQGDSLRSYY ASWYQQKPGQAPVLVIYGKNNRPSGIPDRFS GSSSGNTASLTITGAQAEDEADYYCNSRDSS GNHYVFGTGTKVTVL |
| 1687 | EVQLVESGGGLVKPGGSLRLSCAASGFTFSS DNMNWVRQAPGKGLEWVSSIGSSSSYIYYAD SVKGRFTISRDNAKNSLYLQMNSLRAEDTAV YYCARDRAIVGATWFDPWGQGTLVIVSS | 1823 | SSELTQDPAVSVALGQTVRITCQGDSLRNYY ASWYQQKPGQAPILVIYGKNNRPSGIPDRFS GSSSGNTASLTITGAQAEDEADYYCNSRDSS YNHWVFGGGTKLTVL |
| 1688 | EVQLVESGGGLVKPGGSLRLSCAASGFTFSS YSMNWVRQAPGKGLEWVSSISSSSSYIYYAD SVKGRFTISRDNAKNSLYLQMNSLRAEDTAV YYCARDRYNWNYRYFDLWGRGTLVTVSS | 1824 | SSELTQDPAVSVALGQTVRITCQGDSLRSYY ASWYQQKPGQAPVLVIYGKNNRPSGIPDRFS GSSSGNTASLTITGAQAEDEADYYCNSRDSS GNHLVFGGGTKLTVL |
| 1689 | EVQLVESGGGLVKPGGSLRLSCAASGFTFSS YSMNWVRQAPGKGLEWVSSISSSSSYIYYAD SVKGRFTISRDNAKNSLYLQMNSLRAEDTAV YYCARDSHDYGDSYFDYWGQGTLVTVSS | 1825 | SYELTQPPSVSVSPGQTARITCSGDALPKKY AYWYQQKSGQAPVLVIYEDSKRPSGIPERFS GSSSGTMATLTISGAQVEDEADYYCYSTDSS GNHRVFGGGTKLTVL |
| 1690 | QVQLVQSGAEVKKPGASVKVSCKASGYTFTS YGISWVRQAPGQGLEWMGWISAYNGNTNYAQ KLQGRVTMTTDTSTSTAYMELRSLRSDDTAV YYCARDGAARPPRYMDVWGKGTTVTVSS | 1826 | SSELTQDPAVSVALGQTVRITCQGDSLRSYY ASWYQQKPGQAPVLVIYGKNNRPSGIPDRFS GSSSGNTASLTITGAQAEDEADYYCNSRDSS GNHLVFGGGTKLTVL |

TABLE 9-continued

Full Heavy Chain (HC) and Light Chain (LC) Sequences for EPOR/CD131
Binders

| SEQ ID NO | Full HC AA Sequence | SEQ ID NO | Full LC AA Sequence |
|---|---|---|---|
| 1691 | QVQLVQSGAEVRKPVASVKVSCKASGYTFTD HSIHWVRQAPGQGLEWMGSINPNSGGTNYAQ KFQGRVTMTRDTYNCTAYMELSRLRSDDTAV YYCARSDSGSHYVFFDDWGQGTLVTVSS | 1827 | SSELTQDPAVSVALGQTVRITCQGDSLRSYY ASWYQQKPGQAPVLVIYGKNNRPSGIPDRFS GSSSGNTASLTITGAQAEDEADYYCNSRDSS GNHWVFGGGTKLTVL |
| 1692 | QVQLVQSGSEVKKPGASVKVSCKASGYTFTG YYMYWVRQAPGQGLEWMGWINPNSGGTNYAQ KFQDRVTMTRDTSISTAYMELSRLRSDDTAI YYCARDLDYYGSGNYDYWGQGTLVTVSS | 1828 | SSELTQDPAVSVALGQTVRITCQGDSLRSYY ASWYQQKPGQAPVLVIYGKNNRPSGIPDRFS GSSSGNTASLTITGAQAEDEADYYCNSRDSS DNHRVFGGGTKLTVL |
| 1693 | EVQLVESGGGLVQPGGSLRLSCAASGFTFSS YWMHWVRQAPGKGLVWVSRVNSDGSNTTYAD SVKGRFTISRDNAKNTLYLQMNSLRAEDTAV YYCARNRDYHGSGSFDYWGQGTLVTVSS | 1829 | SSELTQDPAVSVALGQTVRITCQGDSLRSYY ASWYQQKPGQAPVLVIYGQNNRPSGIPDRFS GSSSGNTASLTITGAQAEDEADYYCNSRDSS GNHWVFGGGTKLTVL |
| 1694 | QVQLQQSGPGLVKPSQTLSLTCAISGDNVSS NSAAWNWIRQSPSRGLEWLGRTYYRSKWYND YAVSVKSRITINPDTSKNQFSLHLNSVTPED TALYYCARDWNFAFDIWGQGTMVTVSS | 1830 | SSELTQDPAVSVALGQTVRITCQGDSLRSYY ASWYQQKPGQAPVLVIYGKNNRPSGIPDRFS GSSSGNTASLTITGAQAEDEADYYCNSRDSS GNHLVFGGGTKLTVL |
| 1695 | QVQLVQSGAEVKKPGASVKVSCKASGYTFTS YGITWVRQAPGQGLEWMGWISAYNGNTHYAQ KLQGRVTMTDTSTSTAYMDLRSLRSDDTAV YYCARTIFGVVNNWFDPWGQGTLVTVSS | 1831 | QSVLSQPPSVSEAPRQRVTISCSGSSSNIGY NAVNWYQQLPGKAPKLLISHDDLLPSGVSDR FSGSKSGTSASLAISGLQSDDEADYYCAAWD ARLNGWVFGGGTKLTVL |
| 1696 | QVQLVQSGAEVKKPGASVKVSCKASGYTFTG YYMHWVRQAPGQGLEWMGWINPNSGGTNYAQ KFQGRVTMTRDTSISTAYMELSRLRSDDTAV YYCARDGEQLALNWFDPWGQGTLVTVSS | 1832 | QSALTQPRSVSGSPGQSVTISCTGTSSDVGG YNYVSWYQQHPGKAPKLMIYDVSKRPSGVPD RFSGSKSGNTASLTISGLQAEDEADYYCCSY AGSYTWVFGGGTKLTVL |
| 1697 | EVQLVESGGGLVKPGGSLRLSCAASGFTFSR YSMNWVRQAPGKGLEWVSSIISSTSYIYYAD SVKGRFTISRDNAKNSLYLQMNSLRAEDTAV YYCARETPVTLFDAFDIWGQGTMVTVSS | 1833 | QSVLTQPPSVSGAPGQRVTISCTGSSSNIGA RYDVHWYQLLPGSAPKLLIYDNSDRPSGVPD RFSGSRSGTSASLAITGLQAEDEADYFCQSY DSSLSGSVFGGGTKLTVL |
| 1698 | EVHLVESGGGLVQPGRSLRLSCAASGFTFDE YAMHWVRQVPGKGLEWVSGISWNSGSIGYAD SVKGRFTISRDNAKNSLYLQMNSLRAEDTAL YYCAKDIFTGRAGYFDYWGQGTLVTVSS | 1834 | QSVLTQPPSVSGAPGQRVTISCTGSSSNIGA GYDVHWYQQLPGTAPKLLIYGNSNRPSGVPD RFSGSKSGTSASLAITGLQAEDEADYYCQSY DSSLSGWVFGGGTKLTVL |
| 1699 | QVQLVESGGGVVQPGRSLRLSCAASGFTFSS YGMHWVRQAPGKGLEWVAVIWYDGSNKYYAD SVKGRFTISRDNSKNTLYLQMNSLRAEDTAV YYCARAITGTTGNWFDPWGQGTLVTVSS | 1835 | QSVLTQPPSVSGAPGQRVTISCTGSSSNIGA GYDVHWYQQLPGTAPKLLIHGNSNRPSGVPD RFSGSKSGTSASLAITGLQAEDETDYYCQSY DSSLSGWVFGGGTKLTVL |
| 1700 | QITLKESGPTLVKPTQTLTLTCTFSGFSIST SGVGVGWIRQPPGKALEWLAFIFWNDDKRYS PSLKSRLTITKDTSKNQVVLTMTNMDPVDTA TYYCTHTEYGSSWSVDYWGQGTLVTVSS | 1836 | QAVLTQPASLSASPGASASLTCTLRSGINVG TSRIYWYQQKPGSPPQYLLRYKSDSDKHQDS GVPSRFSGSKDASANAGILLISGLQSEDEAD YYCMIWHSSAVVFGGGTKLTVL |
| 1701 | EVQLVESGGGVVRPGGSLRLSCAASGFTFDD YGMSWVRQAPGKGLEWVSGINWNGGSTGYAD SVKGRFTISRDNAKNSLYLQMNSLRAEDTAL YYCARHFDWLLSNAFDIWGQGTMVTVSS | 1837 | QAVLTQPASLSASPGASASLTCTLRSGINVG TYRIYWYQQKPGSPPQYLLRYKSDSDKQQGS GVPSRFSGSKDASANAGILLISGLQSEDEAD YYCMIWHSSASVVFGGGTKLTVL |
| 1702 | QVQLVQSGAEVKKPGASVKVSCKASGYTFTS YDINWVRQATGQGLEWMGWMNPNSGNTGYAQ KFQGRVTMTRNTSISTAYMELSSLRSEDTAV YYCVRRITVVRGVISLDYWGQGTLVTVSS | 1838 | SYELTQPPSVSVSPGQTAIITCSGAKLGDKY ACWYQKKPGQSPVMVIYQDRKRPSGIPERFS GSNSGNTATLTISGTQAMDEADYYCQAWDSS TAVFGGGTKLTVL |
| 1703 | EVQLVESGGGLVKPGGSLRLSCAASGFTFSS YSMNWVRQAPGKGLEWVSSISSSSSYIYYAD SVKGRFTISRDNAKNSLYLQMNSLRAEDTAV YYCARETYYYDSSGYFDYWGQGTLVTVSS | 1839 | SYELTQPPSVSVSPGQTARITCSGDALPKKY AYWYQQKSGQAPVLVIYEDSKRPSGIPERFS GSSSGTMATLTISGAQVEDEADYYCYSTDSS GNHRVFGGGTKLTVL |
| 1704 | EVQLVESGGGLVQPGGSLRLSCAASGFTFSS YWMSWVRQAPGKGLEWVANIKQDGSEKYYVD SVKGRFTISRDNAKNSLYLQMNSLRAEDTAV YYCARDDTIFGVVTDAFDIWGQGTMVTVSS | 1840 | SSELTQDPAVSVALGQTVRITCQGDSLRSYY ASWYQQKPGQAPVLVIYGKNNRPSGIPDRFS GSSSGNTASLTITGAQAEDEADYYCNSRDSS GNLFGGGTKLTVL |
| 1705 | QVQLQQSGPGLVKPSQTLSLTCAISGDSVSS NSAAWNWIRQSPSRGLEWLGRTYYRSKWYND YAVSVKSRITINPDTSKNQFSLQLNSVTPED TAVYYCARGVGARGWFDPWGQGTLVTVSS | 1841 | SYELTQPPSVSVSPGQTASITCSGDKLGDKY ACWYQQKPGQSPVLVIYQDSKRPSGIPERIS GSNSGNTATLTISGTQAMDEADYYCQAWDSS TAVFGGGTKLTVL |

TABLE 9-continued

Full Heavy Chain (HC) and Light Chain (LC) Sequences for EPOR/CD131
Binders

| SEQ ID NO | Full HC AA Sequence | SEQ ID NO | Full LC AA Sequence |
|---|---|---|---|
| 1706 | EVQLVESGGGLVKPGGSLRLSCAASGFTFST YSMNWVRQAPGKGLEWVSSISSSSTYIYYAD SVKGRFTISRDNAKNSLYLQMNSLRADDTAV YYCARDPPLSGSYAGEFDYWGQGTLVTVSS | 1842 | SSELTQDPAVSVALGQTVRITCQGDSLRSYY ASWYQQKPGQAPVLVIYGKNNRPSGIPDRFS GSSSGNTASLTITGAQAEDEADYYCNSRDSS GNHWVFGGGTKLTVL |
| 1707 | QVTLRESGPALVKPTQTLTLTCTFSGFSLST SGMCVSWIRQPPGKALEWLALIDWDDDKYYS TSLKTRLTISKDTSKNQVVLTMTNMDPVDTA TYYCARRGYSYGWGDFDYWGQGTLVTVSS | 1843 | SYELTQPPSVSVSPGQTARITCSGDALPKKY AYWYQQKSGQAPVLVIYEDSKRPSGIPERFS GSSSGTMATLTISGAQVEDEADYYCYSTDSS GNHRVFGGGTKLTVL |
| 1708 | EVQLVESGGGLVQPGGSLRLSCAASEFIFRS YNMNWVRQAPGKGLEWVSYISISSRTIYYAD SVKGRFTISRDNAKNSLFLQMNSLRDEDTAV YYCARGGLLNWNYEGWFDPWGQGTLVTVSS | 1844 | SYELTQPPSVSVSPGQTARITCSGDALPKKY AYWYQQKSGQAPVLVIYEDSKRPSGIPERFS GSSSGTMATLTISGAQVEDEADYYCYSTDSS GNHRVFGGGTKLTVL |
| 1709 | QVQLVESGGGLVKPGGSLRLSCAASGFTFSD YYMSWIRQAPGKGLEWVSYISSSGSTIYYAD SVKGRFTISRDNAKNSLYLQMNSLRAEDTAV YYCARDGGIAARPDWYFDLWGRGTLVTVSS | 1845 | SYELTQPPSVSVSPGQTARITCSGDALPKKY AYWYQQKSGQAPVLVIYEDSKRPSGIPERFS GSSSGTMATLTISGAQVEDEADYYCYSTDSS GNHRVFGGGTKLTVL |
| 1710 | EVQLVESGGGLVQPGGSLRLSCAASGFTFSS YSMNWVRQAPGKGLEWVSYISSSSTIYYAD SVKGRFTISRDNAKNSLYLQMNSLRDEDTAV YYCARTYYYGSGSYYTLDYWGQGTLVTVSS | 1846 | QSVLTQPPSVSGAPGQRVTISCTGSSSNIGA GYDVHWYQQLPGTAPKLLIYGNSNRPSGVPD RFSGSKSGTSASLAITGLQAEDEADYYCQSY DSSLSGVVFGGGTKLTVL |
| 1711 | QVQLVQSGAEVKKPGASVKVSCKASGYTFTS YDINWVRQATGQGLEWMGWMNPNSGNTGYAQ KFQGRVTMTRNTSISTAYMELSSLRSEDTAV YYCARGGITIFGVVTPFDYWGQGTLVTVSS | 1847 | QAVLTQPASLSASPGASASLTCTLRSGINVG TYRIYWYQQKPGSPPQYLLRYKSDSDKQQGS GVPSRFSGSKDASANAGILLISGLQSEDEAD YYCMIWHSSAWVFGGGTKLTVL |
| 1712 | QVQLQESGPGLVKPSQTLSLTCTVSGGSISS GGYYWSWIRQHPGKGLEWIGYIYYSGSTYYN PSLKSRVTISVDTSKNQFSLKLSSVTAADTA VYYCARDALHYYGSGSAFDYWGQGTLVTVSS | 1848 | SYELTQPPSVSVSPGQTASITCSGDKLGDKY ACWYQQKPGQSPVLVIYQDSKRPSGIPERFS GSNSGNTATLTISGTQAMDEADYYCQAWDSS TVVFGGGTKLTVL |
| 1713 | EVQLVESGGGLVQPGGSLRLSCAASGFTFSS YWMSWVRQAPGKGLEWVANIKQDGSEKYYVD SVKGRFTISRDNAKNSLYLQMNSLRAEDTAV YYCAREGVLWFGEFYYYMDVWGKGTTVTVSS | 1849 | SSELTQDPAVSVALGQTVRITCQGDSLRRYY ASWYQQKPGQAPVLVIYGKNNRPSGIPDRFS GSSSGNTASLTITGAQAEDEADYYCNSRDSS GNHLVFGGGTKLTVL |
| 1714 | EVQLVESGGGLVQPGGSLRLSCAASGFTFSS YSMNWVRQAPGKGLEWVSYISSSSTIYYAD SVKGRFTISRDNAKNSLYLQMNSLRDEDTAV YYCARDGDYYDSSGYYHFDYWGQGTLVTVSS | 1850 | SYELTQPPSVSVSPGQTARITCSGDALPKKY AYWYQQKSGQAPVLVIYEDSKRPSGIPERFS GSSSGTMATLTISGAQVEDEADYYCYSTDSS GNHRVFGGGTKLTVL |
| 1715 | EVQLVESGGGLVQPGGSLRLSCAASGFTFSS YAMSWVRQAPGKGLEWVSAISGSGGSTYYAD SVKGRFTISRDNSKNTLYLQMNSLRAEDTAV YYCAKDRGGENWNYGGWFDPWGQGTLVTVSS | 1851 | SYELTQPPSVSVSPGQTARITCSGDALPKKY AYWYQQKSGQAPVLVIYEDSKRPSGIPERFS GSSSGTMATLTISGAQVEDEADYYCYSTDSS GNHRVFGGGTKLTVL |
| 1716 | QVHLVESGGGVVQPGRSLRLSCAASGFTFSS YGMHWVRQAPGKGLEWVAIIWYDGSNEYYAD SVKGRFTISRDNSKNTLYLQMNTLRAEDTAV YYCAGAYYYDSSGYLNYMDVWGKGTTVTVSS | 1852 | SYVLIQPPSVSVAPGKTARITCGGNNIGGKS VHWYQLKPGQAPVLVICYNRDRPSGIPERFS GSNSGNTATLTISRVEAGDEADYYCQVWDSS SDHPVFGGGTKLTVL |
| 1717 | EVQLVESGGGLVKPGGSLRLSCAASGFTFRN AWMSWVRQAPGKGLEWVGRIKTKTDGGATQY AAPVKGRFTISRDDSKNTLYLQMNSLKTEDT AVYYCTTDHIEYSSLYYFDYWGQGTLVTVSS | 1853 | QSVLTQSPSASGTPGQRVTISCSGSNSNIGF NTVNWYQQLPGTAPKLLIDSNNQRPSGVPDR FSGSTSGTSASLAISGLQSEDEADYYCSSYA GSNNFVFGTGTKVTVL |
| 1718 | QVQLVQSGAEVKKPGASVKVSCKASGYTFTS YGISWVRQAPGQGLEWMGWISAYNGNTNYAQ KLQGRVTMTTDTSTSTAYMELRSLRSDDTAV YYCARQLAYCGGDCYLYFDYWGQGTLVTVSS | 1854 | QSALTQPPSASGSPGQSVTISCTGTSSDVGG YNYVSWYQQHPGKAPKLMIYEVSKRPSGVPD RFSGSKSGNTASLTVSGLQAEDEADYYCSSY AGSNNLVFGGGTKLTVL |
| 1719 | QVQLQQSGPGLVKPSQTLSLTCAISGDSVSS NSAAWNWIRQSPSRGLEWLGRTYYRSKWYND YAVSVKSRITINPDTSKNQFSLQLNSVTPED TAVYYCAREAYWNYGGFDYWGQGTLVTVSS | 1855 | QSALTQPPSASGSPGQSVTISCTGTSSDVGG YNYVSWYQQHPGKAPKLMIYEVSKRPSGVPD RFSGSKSGNTASLTVSGLQAEDEADYYCSSY AGSNNFGVFGGGTKLTVL |

TABLE 9-continued

Full Heavy Chain (HC) and Light Chain (LC) Sequences for EPOR/CD131
Binders

| SEQ ID NO | Full HC AA Sequence | SEQ ID NO | Full LC AA Sequence |
|---|---|---|---|
| 1720 | EVQLVESGGGLVKPGGSLKLSCAASGFTFSS YSMNWVRQAPGKGLEWVSSISSSSSYIYYAD SVKGRFTISRDNAKNSLYLQMNSLRAEDTAV YYCARDGRITMVRGVRNWFDPWGQGTLVTVS S | 1856 | SYELTQPPSVSVSPGQTANITCSGDKLGNKY ACWYQQKPGQSPVLVIFQDNKRPSGIPERFS GSNSGNTATLTIGGTQAMDEADYYCQAWDSS TVVFGGGTKVTVL |
| 1721 | EVQLVESGGGLVQPGGSLRLSCAASGFTFSS YSMNWVRQAPGKGLEWVSYISSSTSTIYYAD SVKGRFTISRDNAKNSLYLQMNSLTDEDTAV YYCARMSSQLELHYYCYYMDVWGKGTTVTVS S | 1857 | SYDLTQPPSVSVSPGQTASITCSGDKLGDKY ACWYQQKPGQSPVLVIYQDIKRPSGIPERFS GSNSGNTATLTISGTQAMDEADYYCQAWDSS TVVFGGGTKLTVL |
| 1722 | EVQLVESGGGLVKPGGSLRLSCAASGFTFSN AWMSWVRQAPGKGLEWVGRIKSKTDGGTTDY AAPVKGRFTISRDDSKNTLYLQMNSLKTEDT AVYYCTTDLGYSGYDWGAFDYWGQGTLVTVS S | 1858 | SYELTQPPSVSVSPGQTASITCSGDKLGDKY ACWYQQKPGQSPVLVIYQDSMRPSGIPERFS GSNSGNTATLTISGTQAMDEADYYCQAWDSS TVVFGGGTKLTVL |
| 1723 | QVQLQQSGPGLVKPSQTLSLTCAISGDSVSS NSAAWNWIRQSPSRGLEWLGRTYYRSKWYND YAVSVKSRITINPDTSKNQFSLQLNSVTPED TAVYYCARDRVNWNDVGFDYWGQGTLVTVSS | 1859 | SYELTQPPSVSVSPGQTASITCSGDKLGDKY ACWYQQKPGQSPVLVIYQDSKRPSGIPERFS GSNSGNTATLTISGTQAMDEADYYCQAWDSS TVVFGGGTKLTVL |
| 1724 | EVQLVESGGGLVQPGGSLRLSCAASGFTFSS YWMSWVRQAPGKGLEWVANIKQDGSEKYYVD SVKGRFTISRDNAKNSLYLQMNSLRAEDTAV YYCARTPGYSSSWYEGPYFDYWGQGTLVTVS S | 1860 | SYELTQPPSVSVSPGQTARITCSGDALPKKY AYWYQQKSGQAPVLVIYEDSKRPSGIPERFS GSSSGTMATLTISGAQVEDEADYYCYSTDSS GNHVVFGGGTKLTVL |
| 1725 | QLQLQESGPGLVKPSETLSLTCTVSGGSITT RSYYWGWLRQPPGKGLEWIGTFYYSGNTYYN PSLQSRVSISVDASKNQFSLQLSSVTAADTA VFYCAREDLIGNDYWGQGTLVTVSS | 1861 | SYELTQPPSVSVSPGQTARITCSGDALPKKY AYWYQQKSGQAPVLVIYEDSKRPSGIPERFS GSSSGTMATLTISGAQVEDEADYYCYSTDSS GNHRVFGGGTKLTVL |
| 1726 | QLQLQESGPGLVKPSETLSLTCTVSGGSIST RSYYWGWLRQPPGKGLEWIGTFYYSGSTYYN PSLKSRVSISVDTSKNQFSLQLSSVTAADTA VYYCAREDLIGNDYWGQGTLVTVSS | 1862 | QSVLTQPPSASGTPGQRVTISCSGSSSNIGI NTVNWYQQVPGTAPKLLIYENNQRPSGVPDR FSGSKSGTSASLAISGLQSEDEADYYCAAWD DSLKVFGGGTKLTVL |
| 1727 | QVQLQQWGAGLLKPSETLSLTCAVYGGSFSG HYWNWIRQPPGKGLEWIGEINHSGFTNYNPS LKSRVTISVDTPKNQFPLNLSSVTAADTAVY YCAREGLTGHVFDIWGQGTMVTVSS | 1863 | QTVVTQEPSLTVSPGGTVTLTCASSTGAVTS GYYPNWFQQKPGQAPRALIYSTSNKHSWTPA RFSGSLLGGKAALTLSGVQPEDEAEYYCLLY YGGAQVFGGGTKLTVL |
| 1728 | QVQLQQWGAGLLKPSETLSLTCAVYGGFLRG YYWSWIRQPPGKGLEWIGEINHSGSTNYNPS LKSRVTISVDTAENQFSLKLNSVTAADTAVY YCAREGLTGHTFDIWGQGTMVTVSS | 1864 | QSALTQPASVSGSPGQSITISCTGTSSDVGG YNYVSWYQQHPGKAPKLMIYDVSKRPSGVSN RFSGSKSGNTASLTISGLQAEDEADYYCCSY AGSSTVVFGGGTKLTVL |
| 1729 | QVQLVQSGAEVKKPGASVKVSCKASGYIFSN YGICWVRQAPGQGLEWMGWINPYNVNRNYAQ SLQGRVTMTTDTSTNSAYMELRSLKSDDTAV YFCARGVWGSYRSHSYYTFMDVWGKGTTVTV SS | 1865 | SYELTQPSSVSVSPGQAARITCSGNLLAKKY PRWFLQKPGQAPIMLTHTDCERPSGIPERFS GSSSGTTVTLTISGAQVEDEADYYCFSAADN TSVFDGGTNLTVL |
| 1730 | EVQLVESGGGLVKPGGSLRLSCAASGFTFSS YSMNWVRQAPGKGLEWVSSISSSSSYIYYAD SVKGRFTISRDNAKNSLYLQMNSLRAEDTAV YYCARDYRPYYDILTGYSHFDYWGQGTLVTV SS | 1866 | SSELTQDPAVSVALGQTVRITCQGDSLRSYY ASWYQQKPGQAPVLVIYGKNNRPSGIPDRFS GSSSGNTASLTITGAQAEDEADYYCNSRDSS GNHVVFGGGTKLTVL |
| 1731 | QVQLVQSGAEVKKPGASVKVSCKASGFTFTS YYIHWVRQAPGQGLEWMGIITPSGGTTSYAQ KFQGRVTMTRDTSTSTVYMELSSLRSEDTAV YYCARRVLWFGELRDYFYYMDVWGKGTTVTI SS | 1867 | SYELTQPPSVSVSPGQTARITCSGDALPKKY AYWFQQKSGQAPVLVIYEDSKRPSGIPERFS GSSSGTMATLIISGAQVEDEADYYCYSTDSS GNHVVFGGGTKLTVL |
| 1732 | QMQLQESGPGLVRPSETLSLTCTVSGGSIST RSYYWGWIRQPPGKGLEWIGSVFYSGSTYYN PSLKSRVAISVDTSKNQFSLKVNSVTAADTA VFYCVRQGYDSWTGYSFFYFDYWGQGTLVTV SS | 1868 | QSALTQPPSASGSPGQSVTISCTGTSSDVGG YNYVSWYQQHPGKAPKLMIYEVSKRPSGVPD RFSGSKSGNTASLTVSGLQAEDEADYYCSSY AGSNNLVFGGGTKLTVL |

TABLE 9-continued

Full Heavy Chain (HC) and Light Chain (LC) Sequences for EPOR/CD131
Binders

| SEQ ID NO | Full HC AA Sequence | SEQ ID NO | Full LC AA Sequence |
|---|---|---|---|
| 1733 | QVQLQQWGAGLLKPSETLSLTCAVYGGSFSV YYWSWIRQPPGKGLEWIGEINHSGSTNYNPS LKSRVTISVDTSKNQFSLKLSSVTAADTAVY YCARGGGYSFGGFDYWGQGTLVTVSS | 1869 | QSVLNQPPSASGTPGQRVTISCSGSSSNIGS KTVNWYQQVPGTAPKLLIYSSNQRPSGVPDR FSGSKSGTSASLAISELQSEDEADYYCTSWD DSLNTWVFGGGTKLTVL |
| 1734 | QLQLQESGPGLVKPSETLALTCTVSGGSISS IIYYWGWIRQPPGKGLEWIGNVYYSGSIYYN PSLKSRVTISVDTSKNQFSLKLSSVTAADTA VYYCARQNWGSDAFDIWGQGTMVTVSS | 1870 | SYELTQPLSLSVALGQTARITCGENNIGSRN VHWYQQKPGQAPVLVIYRDSDRPSGIPERFS GSNSGNTATLTISRAQAGDEADYFCQVWDSS TAVFGGGTKLTVL |
| 1735 | QVQLQQWGAGLLKPSETLSLTCAVYGGSFSG YYWSWIRQPPGKGLEWIGEINHSGNTNYNPS LKSRVTISVDTSKNQFSLKLSSVTAADTAVY YCARGELGIGYWYFDLWGRGTLVTVSS | 1871 | SSELTQDPAVSVALGQTVRITCQGDSLRSYY ASWYQQKPGQAPVLVIYGKNNRPSGIPDRFS GSSSGNTASLTITGAQAEDEADYYCNSRDSS GNHVVFGGGTKLTVL |
| 1736 | QVQLQQWGAGLLKPSETLSLTCAVYGGSFSG YYWSWIRQPPGKGLEWIGEINHSGSTNYNPS LKSRVTISVDTSKNQFSLKLSSVTAADTAVY YCAREGGTTHEPLFDYWGQGTLVTVSS | 1872 | SYELTQPPSVSVSPGQTARITCSGDALPKKY AYWYQQKSGQAPVLVIYEDSKRPSGIPERFS GSSSGTMATLTISGAQVEDEADYYCYSTDSS GNHRVFGGGTKLTVL |
| 1737 | QVQLVQSGAEVKKPGASMKVSCKASGYTFIT YGITWVRQAPGQGLEWMGWISAYNGNANYAQ KVQDRVTMTTDTSTSTAYMELRSLRSDDTAV YYCARAPGGSCGSTNCYKWNYDPYYFDYWGQ GTLVTVSS | 1873 | RSALTQPASVSGSPGQSITISCTGTSSDVGG YNYVSWYHQHPGKAPKLMIYDVSKRPSGVSN RFSGFKSGNTASLTISGLQAEDEADYFCCSY AGSSTLVFGGGTKLTVL |
| 1738 | QVQLVQSGAEVKKPGASVKVSCKASGYTFIT YGISWVRQAPGQGLEWMGWISSYNGNTNYAQ KLQGRVTMTRDTSTSTAYMELRSLRSDDTAV YYCARAPGGDCSSTSCYKWNYDPYYFDYWGQ GTLVTVSS | 1874 | QSALTQPASVSGSPGQSITISCTGTSSDVGG YNHVSWYQQNPGKAPKLMIYDVSKRPSGVSN RFSGSKSGNTASLTISGLQAEDEADYYCCSY AGSSTLVFGGGTKLTVL |

TABLE 10

Hybridoma Antibody Sequences

| Hybridoma clone | SEQ ID NO | VH Sequence | SEQ ID NO | VK Sequence |
|---|---|---|---|---|
| M1 | 1875 | QVQLQESGPGLVKPSQTLSLTCTVSG GSISSGGYYWSWIRQHPGKGLEWIGN IIYYSGNPYYNPSLKSRLIISVDTSKN QFSLRLNSVTAADTAVYYCATFYYGS GSYYNEDYWGQGTLVTVSS | 1956 | DIQMTQSPSSLSASVGDRVTITCR ASQGIRIDLGWYQQKPGKAPKRLI YAASSLKSGVPSRFSGSGSGTEFT LTISSLQPEDFTTYFCLQHNSYPY TFGQGTKLEIK |
| M2 | 1876 | QVQLVESGGGLVKPGGSLRLSCAASG FTFSDSYMSWIRQAPGKGLEWVSYIS NSGSYMYYADSVKGRFTISRDNAKNS LYLQMNNLRAEDTAVYYCARDKLGIG DYWGQGTLVTVSS | 1957 | DIQMTQSPSSLSASVGDRVTITCR ASQGIRNDLGWFQQKPGKAPKRLI YAASRLQSGVPSRFSGSGSGTEFT LTISSLQPEDFATYYCLQHHTYPP TFGQGTKVEIK |
| M3 | 1877 | QVQLQESGPGLVKPSETLSLTCTVSG GSISSYDWSWIRQPPGKGLEWIGYIY YSGSTNYNPSLKSRVTISVDTSKNQF SLKLRSVTAADTAVYYCARKYSYGPF DNWGQGTLVTVSS | 1958 | DIVMTQSPSSLSPSVGDRVTITCR ASQGINNYLAWYQQKPGKVPQLLI YAASTLQSGVPSRFSGSGSGTDFT LTISSLQPEDVATYYCQKYNSXPF TFGPGTKVDIK |
| M9 | 1878 | QVQLQESGPGLVKPSQTLSLTCDISG DSVSSNSAAWNWIRQSPSRGLEWLGR TYYRSKWYNDYAVAVKSRITINPDTS KNQFSLQLNSVTPEDTAVYYCARESS GWYEDYYYYYMDVWGKGTTVTVSS | 1959 | DIQMTQSPSSLSASVGDRVTITCR ASQSISSYLNWYQQKPGKAPKLLI YAASSLQSGVPSRFSGSGSGTDFT LTISSLQPEDFATYYCQQSYSTPF TFGPGTKVDIK |
| M19 | 1879 | QLQLQESGPGLVKPSETLSLTCTVSG GSISSSNHYWGWIRQPPGKGLEWIGT LYYSGSTYYEPSLKSRVTISVDTSMN QFSLNLSSVTATDTAVYNCARGDRYG PFDYWGQGTLVTVSS | 1960 | DIVMTQSPSSLSASVGDRVTITCR ASQGIRDDLGWYQQKPEKAPKRLI CAASSLQSGVPSRFSGSGSGTEFT LTISSLQPEDFATYYCLQYNRYPW TFGQGTKVEIK |

TABLE 10-continued

Hybridoma Antibody Sequences

| Hybridoma clone | SEQ ID NO | VH Sequence | SEQ ID NO | VK Sequence |
|---|---|---|---|---|
| M24 | 1880 | EVQLVESGGGLVKPGGSLRLSCAASG FTFTNAWMNWVRQAPGKGLEWIGRIK SKTAGETTDYAAPVKGRFTISRDDSK NTLYLQMNSLKTEDTAVYYCTTDPDY GDPYYYYYFMDVWGKGTTVTVSS | 1961 | DIQMTQSPSSLSASIGDRVTISCR ASQSISSYLNWYQQKPGKAPKLLI YGASSLQSGVPSRFSGSGSGTDFT LTISSLQPEDFATYYCQQSYSLPL TFGGGTKVEIK |
| M26 | 1881 | QVQLVQSGVEVKKPGASVKVSCKASG YAFSNNDISWVRQAPGQGLEWMAWIT TSNGNTNYAPKLQGRVTMTTDTSTST AYMELRSLKSDDTAVYYCARGGRTGY FDYWGQGTLVTVSS | 1962 | DIVMTQSPLSLPVTPGEPASISCR SSQSLLHSNGYNYLDWYLQKPGQS PQLLIYLGSNRASGVPDRESGSGS GTDSTLKISRVEAEDVGVYYCMQV LQIPLTFGGGTKVEIR |
| M37 | 1882 | QVQLQESGPGLVKPSGTLSLTCAVSG GSITTNNWWSWVRQSPGKGLEWIGEI YHSGNTNYNPSLKSRVTMSVDKSKNQ FSLNLNSVIVADTAVYYCASALGTYY GAFDTWGQGTMVTVSA | 1963 | DIQMTQSPSSLSASVGDRVTITCR ASQSISNYLNWYQQKPGKAPKLLI YAASSLQSGVPSRFSGSGSGTDFT LTISSLQPEDFTTYYCQQSYGTPY TFGQGAKLQIK |
| M38 | 1883 | QVQLVESGGGVVQPGRSLRLSCAASG FTFSSYGMHWVRQAPGKGLEWVAFIW YDGRNKNYVDSVKGRFTISRDNSKNT LYLQMNSLRAEDTAVYYCARDRGDYV FDYWGQGTLVTVSS | 1964 | DIQMTQSPSSLSASVGDRVTITCQ ASQDIRNYLNWYQQKPGKAPKLLI YDASNLETGVPSRFSGSGSGTDFT FTISSLKPEDIATYYCQQYDNLLF TFGPGTKVDIK |
| M41 | 1884 | QVQLVESGGGLVQPGRSLRLSCAASG FTFDDYAIHWVRQAPGKGLEWVSGIS YNSENIGYADSVKGRFTISRDNAKNS LYLQMNSLRSEDTALYYCAKDMFLTW FSSFDYWGQGTLVTVSS | 1965 | ETKLTQSPGTLSLSPGERTTLSCR ASQSISNNYLAWYQQKPGQAPRLL IYRASTRATGIPDRFSGSGSGTDF TLTIRRLEPEDFAVYYCQRYGRSP LTFGGGTKVEIK |
| M43 | 1885 | QVQLQESGPGLVKPSGTLSLTCAVSG GSISSSNWWSWVRQPPGKGLEWIGEI YHSGSINYNPSLKSRVTISVDKSKNQ FSLKLTSVTAADTAVYYCASALGNYY GAFDLWGQGTMVTVSS | 1966 | DIVMTQSPSSLSASVGDRVTITCR ASQTISSYLNWYQQKPGKAPKLLI CAASSLQGGVPSRFSGSGSGTDFT LTISSLQPEDFAPYYCQQSYSTPY TFGQGTKLEIK |
| M52 | 1886 | QLQLQESGPGLAKPSETLSLTCTVSG VSISSNSYYWGWIRQPPGKGLEWIGN IYHSGRTYYNPSLRSRVTISVDTSKN QFSLKLNSVTAADTAVYYCARGYSYG AFDYWGQGTLVTVSS | 1967 | DIQMTQSPSSLSASVGDRVTITCR ASQGIRNDLGWYQQKPGKAPKRLI YAASSLQSGIPSRFSGSGSGTEFT LTISSLQPEDFATYYCLQHNNYPW TFGQGTKVEIK |
| M54 | 1887 | QLQLQESGPGLVKPSETLSLTCSVSG GSISSSGYYWGWIRQPPGKGLDWIGT IYYSGNTNYNPSLNSRVTISVDTSRN QFSLKLRSVTAADTAVYYCARGYSYG PFDYWGQGTLVTVSS | 1968 | EIVMTQSPATLSVSPGERATLSCR ASQSVSSNLAWYQLKPGQAPRLLI YGASTRATGIPARFSGSGSGTEFT LTISSLQSEDFAVYYCHPYNNWPL TFGGGTKVEIK |
| M71 | 1888 | QVQLVESGAEVKKPRASVKVSCKTSG YTFTRHYMHWVRQAPGQGLEWMGIIN PNNNSTSYAQKFQGRITMTRDTSTST VYMELSSLRSEDTAVYYCARFRIVGT TLYFDYWGQGTLVTVSS | 1969 | EIVMTQSPATLSVSPGERATLSCR ASQSVSSNLAWYQLKPGQAPRLLI YGASTRATGIPARFSGSGSGTEFT LTISSLQSEDFAVYYCHPYNNWPL TFGGGTKVEIK |
| M80 | 1889 | QVQLVESGGGLVKPGGSLRLSCAASG FTFSDSYMSWIRQAPGKGLEWVSYIS NSGSYMYYADSVKGRFTISRDNAKNS LYLQMNNLRAEDTAVYYCARDKLGIG DYWGQGTLVTVSS | 1970 | DIVMTQSPLSLPVTPGEPASISCR SSQSLLHSNGYNYLDWYLQKPGQS PQLLIYLGSNRASGVPDRFSGSGS GTDSTLKISRVEAEDVGVYYCMQV LQIPLTFGGGTKVEIR |
| M82 | 1890 | QVQLVQSGAEVKKPGASVKVSCKASG YTFSSFGITWIRQAPGQGLEWMGWIS GYTGNTNYAQNLQGRVTITTDTSTNT AYMELRSLKSDDTAVYYCAREPVLNP NYYYFYYMDVWGQGTTVTVSS | 1971 | EIQLTQSPGTLSLSPGERATLSCR ASQSVRNSYLAWYQQKPGQAPRLL TYGASSRATGIPDRFSGSGSGTDF TLTISRLEPEDCAVYFCQQYGSSP TFGGGTKVDIK |
| M87 | 1891 | QVQLVQSGAEVKKPGASMKVSCKASG YTFTQNHISWVRQAPGQGLEWMGWIS AYSGNTNYAWKFQGRVTMTTDTSTNT AYMELRSLRSDDTAVYYCARDRGNWN DFAYWGRGTLVTVSS | 1972 | DIVMTQSPDSLAVSLGERATINCK SSQSVLYSSNNKNYLAWYQQKPGQ PPKLLIYWASTRESGVPDRFSGSG SGTDFTLTISSLQAEDVAVYYCQQ YYSTPYTFGQGTKLEIK |

TABLE 11

Hybridoma Clones and EPO/EPOR Blocking Efficiency

| Antibody ID | EPO Conc. (nM) | % Inhibition |
|---|---|---|
| EPORab-M1 | 10 | 31.2% |
| EPORab-M2 | 10 | 93.6% |
| EPORab-M3 | 10 | 13.4% |
| EPORab-M4 | 10 | 35.0% |
| EPORab-M5 | 10 | 100.7% |
| EPORab-M6 | 10 | 97.2% |
| EPORab-M7 | 10 | 100.4% |
| EPORab-M8 | 10 | 93.9% |
| EPORab-M9 | 10 | 18.1% |
| EPORab-M10 | 10 | 87.4% |
| EPORab-M11 | 10 | 92.3% |
| EPORab-M12 | 10 | 35.6% |
| EPORab-M13 | 10 | 94.3% |
| EPORab-M14 | 10 | 95.1% |
| EPORab-M15 | 10 | 101.4% |
| EPORab-M16 | 10 | 96.5% |
| EPORab-M17 | 10 | 92.0% |
| EPORab-M18 | 10 | 28.8% |
| EPORab-M19 | 10 | 10.4% |
| EPORab-M20 | 10 | 31.8% |
| EPORab-M21 | 10 | 96.8% |
| EPORab-M22 | 10 | 0.6% |
| EPORab-M23 | 10 | 94.9% |
| EPORab-M24 | 10 | 9.5% |
| EPORab-M25 | 10 | 1.6% |
| EPORab-M26 | 10 | 31.3% |
| EPORab-M27 | 10 | 23.8% |
| EPORab-M28 | 10 | 21.0% |
| EPORab-M29 | 10 | 13.2% |
| EPORab-M30 | 10 | 88.6% |
| EPORab-M31 | 10 | 22.4% |
| EPORab-M32 | 10 | 20.9% |
| EPORab-M33 | 10 | 28.6% |
| EPORab-M34 | 10 | 99.6% |
| EPORab-M35 | 10 | 25.4% |
| EPORab-M36 | 10 | 90 2% |
| EPORab-M37 | 10 | −7.1% |
| EPORab-M38 | 10 | 0.5% |
| EPORab-M39 | 10 | 99.1% |
| EPORab-M40 | 10 | 97.6% |
| EPORab-M41 | 10 | 18.7% |
| EPORab-M42 | 10 | −5.4% |
| EPORab-M43 | 10 | −11.4% |
| EPORab-M44 | 10 | 26.3% |

TABLE 11-continued

Hybridoma Clones and EPO/EPOR Blocking Efficiency

| Antibody ID | EPO Conc. (nM) | % Inhibition |
|---|---|---|
| EPORab-M45 | 10 | 19.5% |
| EPORab-M46 | 10 | 98.4% |
| EPORab-M47 | 10 | 26.5% |
| EPORab-M48 | 10 | 1.3% |
| EPORab-M49 | 10 | 22.4% |
| EPORab-M50 | 10 | 99.0% |
| EPORab-M51 | 10 | 89.8% |
| EPORab-M52 | 10 | 7.4% |
| EPORab-M53 | 10 | 101.6% |
| EPORab-M54 | 10 | 16.0% |
| EPORab-M55 | 10 | 98.3% |
| EPORab-M56 | 10 | 112.1% |
| EPORab-M57 | 10 | 31.5% |
| EPORab-M58 | 10 | 102.8% |
| EPORab-M59 | 10 | 34.5% |
| EPORab-M60 | 10 | 30.0% |
| EPORab-M61 | 10 | 11.2% |
| EPORab-M62 | 10 | 36.3% |
| EPORab-M63 | 10 | 15.0% |
| EPORab-M64 | 10 | 102.0% |
| EPORab-M65 | 10 | 104.2% |
| EPORab-M66 | 10 | 102.8% |
| EPORab-M67 | 10 | 8.9% |
| EPORab-M68 | 10 | 110.3% |
| EPORab-M69 | 10 | 99.2% |
| EPORab-M70 | 10 | 34.3% |
| EPORab-M71 | 10 | 0.1% |
| EPORab-M72 | 10 | 14.8% |
| EPORab-M73 | 10 | 100.6% |
| EPORab-M74 | 10 | 5.1% |
| EPORab-M75 | 10 | 32.7% |
| EPORab-M76 | 10 | 88.6% |
| EPORab-M77 | 10 | 106.6% |
| EPORab-M78 | 10 | 104.8% |
| EPORab-M79 | 10 | −0.8% |
| EPORab-M80 | 10 | −1.8% |
| EPORab-M81 | 10 | 9.7% |
| EPORab-M82 | 10 | 24.8% |
| EPORab-M83 | 10 | 10.1% |
| EPORab-M84 | 10 | 114.7% |
| EPORab-M85 | 10 | 28.5% |
| EPORab-M86 | 10 | 12.6% |
| EPORab-M87 | 10 | 11.5% |

TABLE 12

VH-CDR1, VH-CDR2, VL-CDR1, and VL-CDR2 Sequences for Anti-EPOR Antibodies

| clonotype_id | SEQ ID NO | HCDR1 AA | SEQ ID NO | HCDR2 AA | SEQ ID NO | LCDR1 AA | SEQ ID NO | LCDR2 AA |
|---|---|---|---|---|---|---|---|---|
| clonotype 10 | 2068 | GDSVSSNSA | 2256 | YYRSKWY | 2444 | TGTSSDVGGYN YVS | 2632 | EVSNRPS |
| clonotype 13 | 2069 | GDSVSSNSA | 2257 | YYRSKWY | 2445 | TGTSSDVGGYN YVS | 2633 | DVSKRPS |
| clonotype 22 | 2070 | GFTFDDY | 2258 | NWNGGS | 2446 | SGDKLGDKYAC | 2634 | QDSKRPS |
| clonotype 31 | 2071 | GGSISSSSY | 2259 | YYSGS | 2447 | SGDVLAKKYAR | 2635 | KDSERPS |
| clonotype 33 | 2072 | GFTFSSY | 2260 | SSSSSY | 2448 | QGDSLRSYYAS | 2636 | GKNNRPS |
| clonotype 36 | 2073 | GFTFNNY | 2261 | SSSSSY | 2449 | TGTSSDVGGYN YVS | 2637 | DVSKRPS |

TABLE 12-continued

VH-CDR1, VH-CDR2, VL-CDR1, and VL-CDR2 Sequences for Anti-EPOR
Antibodies

| clonotype_ id | SEQ ID NO | HCDR1 AA | SEQ ID NO | HCDR2 AA | SEQ ID NO | LCDR1 AA | SEQ ID NO | LCDR2 AA |
|---|---|---|---|---|---|---|---|---|
| clonotype 42 | 2074 | GFTFSSY | 2262 | WYDGSN | 2450 | TGTSSDVGGYN YVS | 2638 | EVSKRPS |
| clonotype 43 | 2075 | GFTFSSY | 2263 | SGSGGS | 2451 | TGTSSDVGGYN YVS | 2639 | EVSNRPS |
| clonotype 44 | 2076 | GYTFTSY | 2264 | SPYNGN | 2452 | TGTSSDVGGYN YVS | 2640 | DVSKRPS |
| clonotype 45 | 2077 | GGSFSGY | 2265 | NHSGS | 2453 | QGDSLRSYYAS | 2641 | GKNNRPS |
| clonotype 47 | 2078 | GFTFSSY | 2266 | WYDGSN | 2454 | GGNNIGSKSVH | 2642 | YDSDRPS |
| clonotype 56 | 2079 | GFSFSGS | 2267 | RSKPNNYA | 2455 | TLRSGINVGTY RIY | 2643 | YKSDSDKQQ GS |
| clonotype 58 | 2080 | GYTFTGY | 2268 | NPNSGG | 2456 | QGDSLRSYYAS | 2644 | GKNNRPS |
| clonotype 62 | 2081 | GYTFINY | 2269 | SAYSGN | 2457 | SGDALPKKYAY | 2645 | EDSKRPS |
| clonotype 66 | 2082 | GFTFSSY | 2270 | WYDGSN | 2458 | TGTSSDVGGYN YVS | 2646 | EVSNRPS |
| clonotype 69 | 2083 | GGSISSSN | 2271 | YHSGS | 2459 | TLRSGINVGTY RIY | 2647 | YKSDSDKQQ GS |
| clonotype 75 | 2084 | GFSLSTSGV | 2272 | YWNDD | 2460 | SGDKLGDKYAC | 2648 | QDSKRPS |
| clonotype 80 | 2085 | GFTFSSY | 2273 | SGSGGS | 2461 | SGDALPKKYAY | 2649 | EDSKRPS |
| clonotype 82 | 2086 | GFTFSNA | 2274 | KSKTDGGT | 2462 | QGDSLRSYYAS | 2650 | GKNNRPS |
| clonotype 95 | 2087 | GFTFSSY | 2275 | SSSSST | 2463 | TGTSSDVGGYN YVS | 2651 | DVSKRPS |
| clonotype 99 | 2088 | GFTFDDY | 2276 | NWNGGS | 2464 | TGTSSDVGGYN YVS | 2652 | EVSNRPS |
| clonotype 102 | 2089 | GYSFTSY | 2277 | YPSDSD | 2465 | TGTSSDVGGYN YVS | 2653 | DVSKRPS |
| clonotype 103 | 2090 | GYTFTSY | 2278 | SVYNGN | 2466 | TGTSSDVGGYN YVS | 2654 | DVSKRPS |
| clonotype 109 | 2091 | GDSVSSNSA | 2279 | YYRSKWY | 2467 | TGTSSDVGGYN YVS | 2655 | DVSKRPS |
| clonotype 110 | 2092 | GGSFSGY | 2280 | NHSGS | 2468 | TLSSEHSTYTI E | 2656 | VKSDGSHSK GD |
| clonotype 111 | 2093 | GFTFSSY | 2281 | SSSSSY | 2469 | TLSSEHSTYTI E | 2657 | VKSDGSHSK GD |
| clonotype 112 | 2094 | GFTFSNA | 2282 | KSKTDGGT | 2470 | QGDSLRSYYAS | 2658 | GKNNRPS |
| clonotype 397 | 2095 | GGSISSGGY | 2283 | YYIGI | 2471 | GGNNVGSKSVH | 2659 | YDTDRPS |
| clonotype 398 | 2096 | GGSISSGGY | 2284 | YYSGS | 2472 | GGNTFGSKTVH | 2660 | YDSDRPS |
| clonotype 399 | 2097 | GFTFSNA | 2285 | KSKTDGGT | 2473 | SGDALPKKYAY | 2661 | EDSKRPS |
| clonotype 400 | 2098 | GYTFTSY | 2286 | NPNSGN | 2474 | TGTSSDVGGYN YVS | 2662 | EVSNRPS |

TABLE 12-continued

VH-CDR1, VH-CDR2, VL-CDR1, and VL-CDR2 Sequences for Anti-EPOR
Antibodies

| clonotype_ id | SEQ ID NO | HCDR1 AA | SEQ ID NO | HCDR2 AA | SEQ ID NO | LCDR1 AA | SEQ ID NO | LCDR2 AA |
|---|---|---|---|---|---|---|---|---|
| clonotype 401 | 2099 | GYTFTTY | 2287 | SAYNGN | 2475 | TGTSSDVGGYN YVS | 2663 | EVIKRPS |
| clonotype 402 | 2100 | GFTFSSY | 2288 | SGSGGS | 2476 | SGSSSNIGSNT VN | 2664 | SNNQRPS |
| clonotype 407 | 2101 | GFTFSNA | 2289 | KSKSDGGT | 2477 | SADALPKQYAY | 2665 | KDSERPS |
| clonotype 408 | 2102 | GYTFTSY | 2290 | NPNSGN | 2478 | SGDALPKKYAY | 2666 | EDSKRPS |
| clonotype 409 | 2103 | GFTFSNA | 2291 | KSKTDGGT | 2479 | SADALPKQYAY | 2667 | KDSERPS |
| clonotype 413 | 2104 | GFTFSSY | 2292 | SSSSSY | 2480 | SGDKLGDKYAC | 2668 | QDSKRPS |
| clonotype 414 | 2105 | GYTFTSY | 2293 | NPNSGN | 2481 | SGDKLGDKYAC | 2669 | QDSKRPS |
| clonotype 415 | 2106 | GFTFSNA | 2294 | KSKTDGGT | 2482 | SGDKLGDKYAC | 2670 | QDSKRPS |
| clonotype 418 | 2107 | GFTFSSY | 2295 | SSSSSY | 2483 | QGDSLRSYYAS | 2671 | GKNNRPS |
| clonotype 419 | 2108 | GFTFSSY | 2296 | GTAGD | 2484 | TGTSSDVGGYN YVS | 2672 | DVSKRPS |
| clonotype 420 | 2109 | EFTFRNA | 2297 | RSEIDGGT | 2485 | QGDSLRSYYAS | 2673 | GKNNRPS |
| clonotype 421 | 2110 | GFTFSNA | 2298 | KSKTDGGT | 2486 | QGDSLRSYYAS | 2674 | GKNNRPS |
| clonotype 423 | 2111 | GFTFSNY | 2299 | WYDGSN | 2487 | SGSSSNIGNNA VN | 2675 | YDDLLPS |
| clonotype 424 | 2112 | GFTFSDY | 2300 | SSSGST | 2488 | TGTSSDVGGYN YVS | 2676 | DVSKRPS |
| clonotype 426 | 2113 | GYTFTNY | 2301 | NTYNDK | 2489 | SGDKLGDKHAC | 2677 | QDSKRPS |
| clonotype 427 | 2114 | GYTFTSY | 2302 | SAYNGN | 2490 | SGDVLAKKYAR | 2678 | KDSERPS |
| clonotype 428 | 2115 | GFTFSSY | 2303 | GTAGD | 2491 | SGDVLAKKYAR | 2679 | KDSERPS |
| clonotype 429 | 2116 | GFTFSNA | 2304 | KSKTDGGT | 2492 | SGDVLAKKYAR | 2680 | KDSERPS |
| clonotype 430 | 2117 | GFTFSNA | 2305 | KSKTDGGT | 2493 | SGDVLAKKYAR | 2681 | KDSERPS |
| clonotype 431 | 2118 | GFTFSSY | 2306 | SSSSSY | 2494 | QGDRLRSYYAS | 2682 | GKNNRPS |
| clonotype 432 | 2119 | GFTFSSY | 2307 | KQDGSE | 2495 | QGDSLRSYYAS | 2683 | GKNNRPS |
| clonotype 434 | 2120 | RYTFTSY | 2308 | NPSGGT | 2496 | GGNNIGSKSVH | 2684 | YDSDRPS |
| clonotype 435 | 2121 | GFTFSSY | 2309 | SSSSST | 2497 | SGDALPKKYAY | 2685 | EDSKRPS |
| clonotype 436 | 2122 | GLTVSTN | 2310 | YSGGG | 2498 | ASSTGAVTSGY YPN | 2686 | STSNKHS |

TABLE 12-continued

VH-CDR1, VH-CDR2, VL-CDR1, and VL-CDR2 Sequences for Anti-EPOR
Antibodies

| clonotype_id | SEQ ID NO | HCDR1 AA | SEQ ID NO | HCDR2 AA | SEQ ID NO | LCDR1 AA | SEQ ID NO | LCDR2 AA |
|---|---|---|---|---|---|---|---|---|
| clonotype 437 | 2123 | GFTFDDY | 2311 | NWNGGS | 2499 | TGTSSDVGGYN YVS | 2687 | EVSKRPS |
| clonotype 438 | 2124 | GFTVSSN | 2312 | YSGGS | 2500 | TGTSSDVGGYN YVS | 2688 | DVSKRPS |
| clonotype 439 | 2125 | GFTFSSY | 2313 | SSSSSY | 2501 | TGTSSDVGGYN YVS | 2689 | DVSKRPS |
| clonotype 442 | 2126 | GFTFSSY | 2314 | NSDGSS | 2502 | SGDKLGDKYAC | 2690 | QDSKRPS |
| clonotype 443 | 2127 | GGSISSNN | 2315 | YHSGS | 2503 | SGDKLGDKYAC | 2691 | QDNKRPS |
| clonotype 444 | 2128 | GYTFTRN | 2316 | NTNIGN | 2504 | SGDKLGDKYAC | 2692 | QDSKRPS |
| clonotype 445 | 2129 | GFTFSSY | 2317 | SSSSSY | 2505 | QGDSLRSYYAS | 2693 | GKNNRPS |
| clonotype 446 | 2130 | GYTFTSY | 2318 | SAYNGN | 2506 | SGDALPKKYAY | 2694 | EDSKRPS |
| clonotype 448 | 2131 | GFTFSSY | 2319 | GTAGD | 2507 | QGDSLRSYYAS | 2695 | GKNNRPS |
| clonotype 450 | 2132 | GFTFSSY | 2320 | WYDGSN | 2508 | SGDALPKKYAY | 2696 | EDSKRPS |
| clonotype 451 | 2133 | GYSFTSY | 2321 | YPGDSD | 2509 | GGNNIGSKSVH | 2697 | YDSDRPS |
| clonotype 452 | 2134 | GFTFSNY | 2322 | KYDGRE | 2510 | SGSISNLGSNT VN | 2698 | SNNQRPS |
| clonotype 453 | 2135 | GFTFSSY | 2323 | KQDGSE | 2511 | TGTSSDVGGYN YVS | 2699 | EVSKRPS |
| clonotype 454 | 2136 | GYTFTSY | 2324 | SAYNGN | 2512 | TGTSSDVGGYN YVS | 2700 | EVSKRPS |
| clonotype 455 | 2137 | GFTFSSY | 2325 | NSDGSS | 2513 | TGTSSDVGGYN YVS | 2701 | DVSKRPS |
| clonotype 456 | 2138 | GFTVSSN | 2326 | YSGGS | 2514 | TGTSSDVGGYN YVS | 2702 | DVSKRPS |
| clonotype 457 | 2139 | GFTFDDY | 2327 | SWNSGS | 2515 | TGTSSDVGGYN YVS | 2703 | EVSKRPS |
| clonotype 458 | 2140 | GFTFSDY | 2328 | SSSGST | 2516 | TGSSSNIGAGY DVH | 2704 | GNSNRPS |
| clonotype 459 | 2141 | GFTVSRN | 2329 | YAGGN | 2517 | TGSSSNIGAGY DVH | 2705 | GNNNRPS |
| clonotype 460 | 2142 | GFTFSSY | 2330 | KQDGSE | 2518 | TLRSGINVGTY RIY | 2706 | YKSDSDKQQ GS |
| clonotype 461 | 2143 | GFTFSSY | 2331 | KQDGSE | 2519 | TLRSGINVGTY RIY | 2707 | YKSDSDKQQ GS |
| clonotype 464 | 2144 | GFTFSRY | 2332 | NIVGST | 2520 | RGNNIGSQNVH | 2708 | RNINRPS |
| clonotype 465 | 2145 | GFTFSSY | 2333 | SSSSSY | 2521 | SGDALPKKYAY | 2709 | EDSKRPS |
| clonotype 466 | 2146 | GFTFSIY | 2334 | KEDGSE | 2522 | QGDSLRSFYAS | 2710 | GKSNRPS |
| clonotype 468 | 2147 | GYTFTSY | 2335 | SAYNGN | 2523 | QGDSLRSYYAS | 2711 | GKNNRPS |

TABLE 12-continued

| clonotype_id | SEQ ID NO | HCDR1 AA | SEQ ID NO | HCDR2 AA | SEQ ID NO | LCDR1 AA | SEQ ID NO | LCDR2 AA |
|---|---|---|---|---|---|---|---|---|
| clonotype 469 | 2148 | GYTFTSY | 2336 | NPNSGN | 2524 | SGDALPKKYAY | 2712 | EDSKRPS |
| clonotype 470 | 2149 | GYTFTSY | 2337 | NPSGGS | 2525 | QGDSLRSYYAS | 2713 | GKNNRPS |
| clonotype 471 | 2150 | GFTFSSY | 2338 | GTAGD | 2526 | SGDALPKKYAY | 2714 | EDSKRPS |
| clonotype 474 | 2151 | GFTFSNA | 2339 | KSKTDGGT | 2527 | ASSTGAVTSGY YPN | 2715 | STSNKHS |
| clonotype 475 | 2152 | GFTFSSH | 2340 | SSNGGN | 2528 | TGTSSDVGGYN YVS | 2716 | EVSNRPS |
| clonotype 476 | 2153 | GFTFSSY | 2341 | SSSSSY | 2529 | SGSSSNIGSNT VN | 2717 | SNNQRPS |
| clonotype 477 | 2154 | GGSFSGY | 2342 | NHSGS | 2530 | TGTSSDVGGYN YVS | 2718 | EVSKRPS |
| clonotype 478 | 2155 | GYTFTSY | 2343 | NPSGGS | 2531 | TGTSSDVGGYN YVS | 2719 | DVSKRPS |
| clonotype 479 | 2156 | GFTFSDY | 2344 | SSSGST | 2532 | TGTSSDVGGYN YVS | 2720 | DVSKRPS |
| clonotype 480 | 2157 | GYSFTSY | 2345 | YPGDSD | 2533 | TGTSSDVGGYN YVS | 2721 | EVSKRPS |
| clonotype 481 | 2158 | GFTFSSY | 2346 | SSSSST | 2534 | TLRSGINVGTY RIY | 2722 | YKSDSDKQQ GS |
| clonotype 486 | 2159 | GGSISSGGY | 2347 | FYSGS | 2535 | SGDKLGDKYAC | 2723 | QDSKRPS |
| clonotype 487 | 2160 | GFSLSTSGV | 2348 | YWNDD | 2536 | SADALPKQYAY | 2724 | KDSERPS |
| clonotype 488 | 2161 | GFTFSSY | 2349 | SYDGSN | 2537 | SGDKLGDKYAC | 2725 | QDTKRPS |
| clonotype 490 | 2162 | GFSLSTSGV | 2350 | YWSDD | 2538 | SADALPNQYAY | 2726 | KDSERPS |
| clonotype 492 | 2163 | GYPFTSY | 2351 | SAYNSN | 2539 | QGDSLRSYYAS | 2727 | GKNNRPS |
| clonotype 493 | 2164 | GYSFTGY | 2352 | SAYNGN | 2540 | SGDALPKKYAY | 2728 | EDSKRPS |
| clonotype 494 | 2165 | GYTFSSY | 2353 | NTNTGN | 2541 | QGDSLRSYYAS | 2729 | GKNNRPS |
| clonotype 495 | 2166 | GYTFTGY | 2354 | NPNSGG | 2542 | SGDALPKKYAY | 2730 | EDSKRPS |
| clonotype 496 | 2167 | GYTFTSY | 2355 | NPNSGN | 2543 | SGDALPKKYAY | 2731 | EDSKRPS |
| clonotype 497 | 2168 | GYTFTSY | 2356 | NPNSGN | 2544 | SGDALPKKYAY | 2732 | EDSKRPS |
| clonotype 498 | 2169 | GDTFSNF | 2357 | IPIFAT | 2545 | GGNNIGSKSVH | 2733 | YDSDRPS |
| clonotype 499 | 2170 | GFTFSNA | 2358 | KRKTDGGT | 2546 | SADALPKQYAY | 2734 | KDSERPS |
| clonotype 501 | 2171 | GDSVSSNSA | 2359 | YYRSKWY | 2547 | QGDSLRSYYAS | 2735 | GKNNRPS |

TABLE 12-continued

VH-CDR1, VH-CDR2, VL-CDR1, and VL-CDR2 Sequences for Anti-EPOR
Antibodies

| clonotype_ id | SEQ ID NO | HCDR1 AA | SEQ ID NO | HCDR2 AA | SEQ ID NO | LCDR1 AA | SEQ ID NO | LCDR2 AA |
|---|---|---|---|---|---|---|---|---|
| clonotype 502 | 2172 | GFTFNNA | 2360 | KSKTDGGT | 2548 | GSSTGAVTSGH YPY | 2736 | DTSNKHS |
| clonotype 504 | 2173 | GFTFSNA | 2361 | KSKTDGGT | 2549 | TGTSSDVGGYN YVS | 2737 | EVSKRPS |
| clonotype 505 | 2174 | GFTFSSY | 2362 | SYDGSN | 2550 | TGTSSDVGGYN YVS | 2738 | DVSKRPS |
| clonotype 506 | 2175 | GFTFDDY | 2363 | NWNGGS | 2551 | TGTSSDVGGYN YVS | 2739 | EVSNRPS |
| clonotype 507 | 2176 | GDSVSSNSA | 2364 | YYRSKWY | 2552 | TGTSSDVGGYN YVS | 2740 | DVSKRPS |
| clonotype 508 | 2177 | GFTFDDY | 2365 | SWNSGS | 2553 | TGTSSDVGGYN YVS | 2741 | DVSKRPS |
| clonotype 509 | 2178 | GFTFSSY | 2366 | SSSSNT | 2554 | TGTSSDVGGYN YVS | 2742 | EVSKRPS |
| clonotype 511 | 2179 | GYTFTSY | 2367 | NPSGGS | 2555 | SGDKLGDKYAC | 2743 | QDSKRPS |
| clonotype 512 | 2180 | GFNFSSY | 2368 | SNTGNT | 2556 | SGDVLAKKYAR | 2744 | KDSERPS |
| clonotype 513 | 2181 | GFTFSNA | 2369 | KRKTDGGT | 2557 | SGDKLGDKYAC | 2745 | QDSKRPS |
| clonotype 514 | 2182 | GFTFSSY | 2370 | NSDGSS | 2558 | SGDKLGDKYAC | 2746 | QDSKRPS |
| clonotype 515 | 2183 | GFTFSSY | 2371 | SGSGGS | 2559 | SGDALPKKYAY | 2747 | EDSKRPS |
| clonotype 517 | 2184 | GGSISSNN | 2372 | YHSGS | 2560 | SGDALPKKYAY | 2748 | EDSKRPS |
| clonotype 518 | 2185 | GGSISSSN | 2373 | YHSGS | 2561 | TGTSSDVGGYN YVS | 2749 | DVSKRPS |
| clonotype 519 | 2186 | GGSIISSN | 2374 | YHSGS | 2562 | QGDSLRSYYAS | 2750 | GKNNRPS |
| clonotype 520 | 2187 | GFTFSSY | 2375 | SSSSSY | 2563 | QGDSLRSYYAS | 2751 | GKNNRPS |
| clonotype 522 | 2188 | GFTFSSY | 2376 | KQDGSE | 2564 | QGDSLRSYYAS | 2752 | GKNNRPS |
| clonotype 523 | 2189 | GFSLNSSGV | 2377 | YWNGD | 2565 | GGNNIGSKSVH | 2753 | YDSDRPS |
| clonotype 524 | 2190 | GYIFMNY | 2378 | SAYNGN | 2566 | QGDSLRSYYAS | 2754 | GKNNRPS |
| clonotype 526 | 2191 | GYTFTNY | 2379 | NTNTGK | 2567 | QGDSLRSYYAS | 2755 | GKNNRPS |
| clonotype 527 | 2192 | GYTFTDN | 2380 | NPNSGG | 2568 | QGDSLRSYYAS | 2756 | GKNNRPS |
| clonotype 528 | 2193 | GYTFTSY | 2381 | NPSGGS | 2569 | QGDSLRSYYAS | 2757 | GKKNRPS |
| clonotype 529 | 2194 | GFTFSSY | 2382 | SSSSST | 2570 | SGDALPKKYAY | 2758 | EDSKRPS |
| clonotype 530 | 2195 | GFTFSNY | 2383 | SGSGGR | 2571 | QGDSFRNYYAS | 2759 | GKNNRPS |
| clonotype 531 | 2196 | GFTFSSY | 2384 | SYDGSN | 2572 | QGDSLRSYYAS | 2760 | GKNNRPS |

TABLE 12-continued

| clonotype_id | SEQ ID NO | HCDR1 AA | SEQ ID NO | HCDR2 AA | SEQ ID NO | LCDR1 AA | SEQ ID NO | LCDR2 AA |
|---|---|---|---|---|---|---|---|---|
| clonotype 532 | 2197 | GYRFSNY | 2385 | YPGDSD | 2573 | QGDSLRSYYAS | 2761 | GKNNRPS |
| clonotype 534 | 2198 | GYTFTSY | 2386 | NTNTGN | 2574 | ASSTGAVTSGYYPN | 2762 | STSNKHS |
| clonotype 537 | 2199 | GFTFSSY | 2387 | WYDGSN | 2575 | TGTSSDVGVYNFVS | 2763 | DVTKRPS |
| clonotype 538 | 2200 | GYTFTGY | 2388 | NPNSGG | 2576 | TGSSSNIGAGYDVH | 2764 | VNNNRPS |
| clonotype 539 | 2201 | GDSVSSNSA | 2389 | YYRSKWY | 2577 | TGTSSDVGGYNYVS | 2765 | DVSKRPS |
| clonotype 540 | 2202 | GYTFTSY | 2390 | SAYNGN | 2578 | TGSSSNIGAGYDVH | 2766 | GNSNRPS |
| clonotype 541 | 2203 | GFSITTSGV | 2391 | YWNDD | 2579 | TLRSGIHVDTSRIY | 2767 | YKSDSDKHQDS |
| clonotype 542 | 2204 | GFSLSTSGV | 2392 | YWNDD | 2580 | TLRSGINVGSYRIY | 2768 | YKSDSDKQQGS |
| clonotype 543 | 2205 | GYTFTSY | 2393 | NPNSGN | 2581 | TLRSGINVGTYRIY | 2769 | YKSDSDKQQGS |
| clonotype 548 | 2206 | GFSLSTSGM | 2394 | DWDDD | 2582 | QGDSLRSYYAS | 2770 | GKNNRPS |
| clonotype 549 | 2207 | GYTFTSY | 2395 | SGYKGN | 2583 | QGDSLRSYYAS | 2771 | GKNNRPS |
| clonotype 550 | 2208 | GDTFTNC | 2396 | SAYNGN | 2584 | QGDSLRSYYAS | 2772 | GKNNRPS |
| clonotype 552 | 2209 | GFTFDDY | 2397 | SKNSGS | 2585 | QGDSLRSYYAS | 2773 | GKNNRPS |
| clonotype 553 | 2210 | GFTFSSY | 2398 | SSSSST | 2586 | QGDSLRSYYAS | 2774 | HKNNRPS |
| clonotype 554 | 2211 | GFTFSSY | 2399 | SGSGGS | 2587 | QGDSLRSYYAS | 2775 | GKNNRPS |
| clonotype 555 | 2212 | GFTFSSY | 2400 | WYDGSN | 2588 | SGDALPKKYAY | 2776 | EDSKRPS |
| clonotype 559 | 2213 | GYTFTGY | 2401 | NPNSGG | 2589 | TGTSSDVGGYNYVS | 2777 | EVSKRPS |
| clonotype 560 | 2214 | GFTFSSY | 2402 | SSSSST | 2590 | TGTSSDVGGYNYVS | 2778 | EVSKRPS |
| clonotype 561 | 2215 | GFTFSDY | 2403 | SSSGST | 2591 | ASSTGAVTSGYYPN | 2779 | STSNKHS |
| clonotype 562 | 2216 | GYTFNSY | 2404 | NTNTGN | 2592 | TGSNSNIGAGYDIH | 2780 | GNSNRPS |
| clonotype 568 | 2217 | GGSISRSSY | 2405 | YYSGS | 2593 | SGDVLAKKFAR | 2781 | KDSERPS |
| clonotype 569 | 2218 | GGSISSSF | 2406 | YHSGS | 2594 | SGDALPKKYAY | 2782 | EDSKRPS |
| clonotype 573 | 2219 | GFTFSNA | 2407 | KSKSDGET | 2595 | GGNNFGSKSVH | 2783 | YDSDRPS |
| clonotype 576 | 2220 | GGSISSY | 2408 | YYSGS | 2596 | TGTSSDVGAYNYVS | 2784 | AVSKRPS |

TABLE 12-continued

| | | | | | | | |
|---|---|---|---|---|---|---|---|
| VH-CDR1, VH-CDR2, VL-CDR1, and VL-CDR2 Sequences for Anti-EPOR Antibodies | | | | | | | |
| clonotype_id | SEQ ID NO | HCDR1 AA | SEQ ID NO | HCDR2 AA | SEQ ID NO | LCDR1 AA | SEQ ID NO | LCDR2 AA |
| clonotype 577 | 2221 | GFTFSSY | 2409 | SGSGGS | 2597 | TGTSSDVGGYN YVS | 2785 | DVSKRPS |
| clonotype 578 | 2222 | GFTFGDF | 2410 | NWNGGS | 2598 | TGTSSDVGGYN YVS | 2786 | EVNKRPS |
| clonotype 579 | 2223 | GDSVSSNSA | 2411 | YYRSKWY | 2599 | TGTSSDVGGYN YVS | 2787 | DVSKRPS |
| clonotype 581 | 2224 | GFTFSSY | 2412 | SSSSST | 2600 | TGSSSNIGAGY DVH | 2788 | GNSNRPS |
| clonotype 582 | 2225 | GDSVSSNSA | 2413 | YYMSKWY | 2601 | TGTSSDVGSYN RVS | 2789 | DVSNRPS |
| clonotype 583 | 2226 | GYTFTTY | 2414 | SAYNGN | 2602 | TGSDSNIGAGY DVH | 2790 | DNIIRPS |
| clonotype 586 | 2227 | GFTFDDY | 2415 | NWNGGS | 2603 | SGDKLGDKYAC | 2791 | QDSKRPS |
| clonotype 587 | 2228 | GDSVSSNSA | 2416 | YYRSKWY | 2604 | SGDGLSKKYAY | 2792 | EDSKRPS |
| clonotype 588 | 2229 | AFTFSNY | 2417 | SSSTSY | 2605 | QGDSLRSYYAS | 2793 | GKNNRPS |
| clonotype 589 | 2230 | GFTFSSY | 2418 | SSSSSY | 2606 | QGDSLRSYYAS | 2794 | GKNNRPS |
| clonotype 596 | 2231 | GFTFSNA | 2419 | KSKTDGGT | 2607 | SGDALPKKYAY | 2795 | EDSKRPS |
| clonotype 598 | 2232 | GFTFSSH | 2420 | SGSESS | 2608 | QGDSLRSYYAS | 2796 | GKNNRPS |
| clonoypet 599 | 2233 | GFTFSSY | 2421 | WYDGSN | 2609 | QGDSLRSYYAS | 2797 | GKNNRPS |
| clonotype 600 | 2234 | GGSISSSSY | 2422 | HYSGS | 2610 | QGDSLRSYYAS | 2798 | GKNNRPS |
| clonotype 601 | 2235 | GYSFSSY | 2423 | SGYNGN | 2611 | TGTSSDVGGYN YVS | 2799 | EVSNRPS |
| clonotype 602 | 2236 | GFTFSNA | 2424 | KSKTDGGT | 2612 | TGTSSDVGGYN YVS | 2800 | DVSKRPS |
| clonotype 607 | 2237 | GFTFSTY | 2425 | SSGSST | 2613 | QGDSLRSYYAT | 2801 | GRNNRPS |
| clonotype 608 | 2238 | GFTFSNA | 2426 | KSKTDGGT | 2614 | GGNNIGSKSVH | 2802 | YDSDRPS |
| clonotype 610 | 2239 | GGSITTRSY | 2427 | YYSGN | 2615 | QGDSLRSYYAS | 2803 | GKNNRPS |
| clonotype 611 | 2240 | GDSVSSNSA | 2428 | YYRSKWY | 2616 | QGDSLRSYYAS | 2804 | GKNKRPS |
| clonotype 612 | 2241 | GFTFDDY | 2429 | NWNGGS | 2617 | TGTSSDVGGYN YVS | 2805 | DVSKRPS |
| clonotype 613 | 2242 | GYTFTGN | 2430 | NPTSGV | 2618 | TGSSSNIGARY DVH | 2806 | GNSNRPS |
| clonotype 616 | 2243 | GYTFTDY | 2431 | NPNSGG | 2619 | QGDSLRSYYAS | 2807 | GKNNRPS |
| clonotype 617 | 2244 | GGSISSRSY | 2432 | FYSGS | 2620 | TGTSSDVGGYN YVS | 2808 | DVSKRPS |
| clonotype 622 | 2245 | GFTFSGS | 2433 | RSKANSYA | 2621 | SGDKLGDKYAC | 2809 | QDSKRPS |

TABLE 12-continued

VH-CDR1, VH-CDR2, VL-CDR1, and VL-CDR2 Sequences for Anti-EPOR
Antibodies

| clonotype_id | SEQ ID NO | HCDR1 AA | SEQ ID NO | HCDR2 AA | SEQ ID NO | LCDR1 AA | SEQ ID NO | LCDR2 AA |
|---|---|---|---|---|---|---|---|---|
| clonotype 625 | 2246 | GGSFSGY | 2434 | NHSGS | 2622 | SGDALPKKYAY | 2810 | EDNKRPS |
| clonotype 626 | 2247 | GGSFSGY | 2435 | NRSGS | 2623 | QGDSLRNYYAS | 2811 | GKNNRPS |
| clonotype 629 | 2248 | GGSISSSSY | 2436 | YYSGS | 2624 | TGTSSDVGGYN YVS | 2812 | EVSKRPS |
| clonotype 630 | 2249 | GGSISSSSY | 2437 | YYSGS | 2625 | QGDSLRTYYAS | 2813 | GKNKRPS |
| clonotype 634 | 2250 | GFTFRSY | 2438 | NQDGSE | 2626 | GGDNIGIKNVH | 2814 | DDSDRPS |
| clonotype 638 | 2251 | GGSINSSNF | 2439 | FYSGF | 2627 | SGDKLGDKYTC | 2815 | QDIKRPS |
| clonotype 641 | 2252 | GGSISSSSY | 2440 | YYSGS | 2628 | QGDSLRSYYAS | 2816 | GKNNRPS |
| clonotype 644 | 2253 | GGSFSGY | 2441 | NRGGS | 2629 | TGTSSDVGGYN YVS | 2817 | EVSKRPS |
| clonotype 646 | 2254 | GGSISSSGY | 2442 | YYSGS | 2630 | TGTSSDVGGYN YVS | 2818 | EVSNRPS |
| clonotype 647 | 2255 | GGSFSGY | 2443 | NHSGS | 2631 | GSSTGAVTSGH YPY | 2819 | DTSNKHS |

TABLE 13

VH-CDR1, VH-CDR2, VL-CDR1, and VL-CDR2 Sequences for Anti-
CD131 Antibodies

| clono-type_id | SEQ ID NO | HCDR1 AA | SEQ ID NO | HCDR2 AA | SEQ ID NO | LCDR1 AA | SEQ ID NO | LCDR2 AA |
|---|---|---|---|---|---|---|---|---|
| clonotype 8 | 2820 | GGSISSSSY | 2949 | YYSGS | 3078 | TGTSSDVGGYNY VS | 3207 | EVSNRPS |
| clonotype 11 | 2821 | GFTFSNA | 2950 | KSKTDGGT | 3079 | SGDALPKKYAY | 3208 | EDSKRPS |
| clonotype 14 | 2822 | GFTFDDY | 2951 | NWNGGS | 3080 | TGSSSNIGAGYD VH | 3209 | GNSNRPS |
| clonotype 15 | 2823 | GFTFSSY | 2952 | SSSSST | 3081 | SGDVLAKKYAR | 3210 | KDSERPS |
| clonotype 16 | 2824 | GFTFSSS | 2953 | YTTGD | 3082 | SGDALPKKYAY | 3211 | EDSKRPS |
| clonotype 17 | 2825 | GFTFSSY | 2954 | SGSGGS | 3083 | TGSSSNIGAGYD VH | 3212 | GNSNRPS |
| clonotype 25 | 2826 | GYTFTSY | 2955 | SAYNGN | 3084 | TGTSSDVGGYNY VS | 3213 | EVSKRPS |
| clonotype 27 | 2827 | GFTFSSY | 2956 | SGSGGS | 3085 | TGTSSDVGGYNY VS | 3214 | DVSKRPS |
| clonotype 36 | 2828 | GGSFSGY | 2957 | NHSGS | 3086 | QGDSLRSYYAS | 3215 | GKNNRPS |
| clonotype 37 | 2829 | GFTFSSY | 2958 | WYDGSN | 3087 | GGNNIGSKSVH | 3216 | YDSDRPS |
| clonotype 44 | 2830 | GYTFTSY | 2959 | SAYNGN | 3088 | SGSSSNIGSNTV N | 3217 | SNNQRPS |

TABLE 13-continued

VH-CDR1, VH-CDR2, VL-CDR1, and VL-CDR2 Sequences for Anti-
CD131 Antibodies

| clono-type_id | SEQ ID NO | HCDR1 AA | SEQ ID NO | HCDR2 AA | SEQ ID NO | LCDR1 AA | SEQ ID NO | LCDR2 AA |
|---|---|---|---|---|---|---|---|---|
| clonotype 45 | 2831 | GGSFSGY | 2960 | NHSGS | 3089 | TGTSSDVGGYNYVS | 3218 | EVSKRPS |
| clonotype 47 | 2832 | GFTVSSN | 2961 | YSGGS | 3090 | SGSSSNIGNNAVN | 3219 | YDDLLPS |
| clonotype 52 | 2833 | GFTFSTY | 2962 | SGSSSY | 3091 | GGNNIGSKNVH | 3220 | RDSNRPS |
| clonotype 115 | 2834 | GFTFSSY | 2963 | GTAGD | 3092 | SGDALPKKYAY | 3221 | EDSKRPS |
| clonotype 116 | 2835 | GYTFTTY | 2964 | SAYNGN | 3093 | TGTSSDVGGYNYVS | 3222 | EVIKRPS |
| clonotype 118 | 2836 | GFTFSVS | 2965 | RSKANSYA | 3094 | SGDKLGDKYAC | 3223 | QDSKRPS |
| clonotype 119 | 2837 | GFTFSNA | 2966 | KSKTDGGT | 3095 | SADALPNQYAY | 3224 | KDSERPS |
| clonotype 122 | 2838 | GFTFDDY | 2967 | SWNSGS | 3096 | SGDALPKKYAY | 3225 | EDSKRPS |
| clonotype 123 | 2839 | GFTFSDA | 2968 | KSKTDGGT | 3097 | SGDALPKKYAY | 3226 | EDSKRPS |
| clonotype 124 | 2840 | GFTFDDY | 2969 | NWNGGS | 3098 | SGDALPKKYAY | 3227 | EDSKRPS |
| clonotype 125 | 2841 | GFTVSSN | 2970 | YSGGS | 3099 | SGDALPKKYAY | 3228 | EDSKRPS |
| clonotype 126 | 2842 | GYTFTSF | 2971 | SAYNDN | 3100 | TGTSSDVGGYNYVS | 3229 | EVSDRPS |
| clonotype 127 | 2843 | GFTFSGS | 2972 | RSKANSYA | 3101 | TGTSSDVGGYNYVS | 3230 | EVSNRPS |
| clonotype 128 | 2844 | GFTVSSN | 2973 | YSGGS | 3102 | TGTSSDVGGYNYVS | 3231 | DVSKRPS |
| clonotype 130 | 2845 | GFTFSSY | 2974 | SSSSSY | 3103 | SGDVLAKKYAR | 3232 | KDSERPS |
| clonotype 132 | 2846 | GFTFSSY | 2975 | GTAGD | 3104 | SADALPKQYAY | 3233 | KDSERPS |
| clonotype 133 | 2847 | GFTFSSY | 2976 | SSSSSY | 3105 | SGDALPKKYAY | 3234 | EDSKRPS |
| clonotype 134 | 2848 | GFTFSSY | 2977 | KQDGSE | 3106 | SGDALPKKYAY | 3235 | EDSKRPS |
| clonotype 135 | 2849 | GFTFSSY | 2978 | SGSGGS | 3107 | SGDALPKKYAY | 3236 | EDSKRPS |
| clonotype 136 | 2850 | GFTFSSY | 2979 | SGSGGS | 3108 | SGDALPKKYAY | 3237 | EDSKRPS |
| clonotype 137 | 2851 | GFTFSSY | 2980 | SGSGGS | 3109 | SGDALPKKYAY | 3238 | EDSKRPS |
| clonotype 138 | 2852 | GFTFSSY | 2981 | WYDGSN | 3110 | GGNNIGSKNVH | 3239 | RDSNRPS |
| clonotype 140 | 2853 | GFPFSNS | 2982 | SYDGNS | 3111 | QGDSLRSYYAS | 3240 | GKNNRPS |
| clonotype 141 | 2854 | GYTFTGY | 2983 | NPNSGG | 3112 | ASSTGAVTSGYYPN | 3241 | STSNKHS |

TABLE 13-continued

VH-CDR1, VH-CDR2, VL-CDR1, and VL-CDR2 Sequences for Anti-
CD131 Antibodies

| clono-type_id | SEQ ID NO | HCDR1 AA | SEQ ID NO | HCDR2 AA | SEQ ID NO | LCDR1 AA | SEQ ID NO | LCDR2 AA |
|---|---|---|---|---|---|---|---|---|
| clonotype 143 | 2855 | GFTFSNA | 2984 | KSKTDGGT | 3113 | SGSSSNIGSNTV N | 3242 | SNNQRPS |
| clonotype 145 | 2856 | GYTFTSY | 2985 | NPNSGN | 3114 | SGDKLGDKYAC | 3243 | QDSKRPS |
| clonotype 146 | 2857 | GFTFSSY | 2986 | SYDGSN | 3115 | SGDKLGDKYAC | 3244 | QDSKRPS |
| clonotype 147 | 2858 | GYSFTSY | 2987 | YPGDSD | 3116 | SGDKLGDKYAC | 3245 | QDSKRPS |
| clonotype 148 | 2859 | GFTFSSY | 2988 | SSSSSY | 3117 | SGDALPKKYAY | 3246 | EDSKRPS |
| clonotype 150 | 2860 | GYTFTGY | 2989 | NPNSGG | 3118 | SGDALPKKYAY | 3247 | EDSKRPS |
| clonotype 151 | 2861 | GFTFSSY | 2990 | GTAGD | 3119 | SGDALPKKYAY | 3248 | EDSKRPS |
| clonotype 152 | 2862 | GFTFSNA | 2991 | KSKTDGGT | 3120 | SGDALPKKYAY | 3249 | EDSKRPS |
| clonotype 153 | 2863 | GFTFSSY | 2992 | SGSGGS | 3121 | SGDALPKKYAY | 3250 | EDSKRPS |
| clonotype 154 | 2864 | GFTFSSY | 2993 | SGSGGS | 3122 | SGDALPKKYAY | 3251 | EDSKRPS |
| clonotype 156 | 2865 | GFTFSSY | 2994 | SGSGGS | 3123 | SGDALPKKYAY | 3252 | EDSKRPS |
| clonotype 157 | 2866 | GFTFSSY | 2995 | WYDGSN | 3124 | QGDSLRSYYAS | 3253 | GKNNRPS |
| clonotype 158 | 2867 | GFTFDDY | 2996 | NWNGGS | 3125 | QGDSLRSYYAS | 3254 | GKNNRPS |
| clonotype 159 | 2868 | GYSFTSY | 2997 | YPGDSD | 3126 | SGDALPKKYAY | 3255 | EDSKRPS |
| clonotype 160 | 2869 | GYTFTGY | 2998 | NPNSGG | 3127 | TGTSSDVGGYNY VS | 3256 | DVSNRPS |
| clonotype 161 | 2870 | GFTFDDH | 2999 | TWNSNI | 3128 | TGTSSDVGGYNY VS | 3257 | EVSNRPS |
| clonotype 162 | 2871 | GFTFDDY | 3000 | SWNSGS | 3129 | TGTSSDVGGYNY VS | 3258 | EVSNRPS |
| clonotype 164 | 2872 | GFTFSSY | 3001 | NSDGGN | 3130 | TLRSGIYVGTYR IY | 3259 | YKSDSDKQ QGS |
| clonotype 165 | 2873 | GFTFSSY | 3002 | KQDGSE | 3131 | SGDKLGDKYAC | 3260 | QDSKRPS |
| clonotype 166 | 2874 | GYTFTSY | 3003 | NPNSGN | 3132 | SGDKLGDKYAC | 3261 | QDSKRPS |
| clonotype 167 | 2875 | GFTFSSY | 3004 | WYDGSN | 3133 | SGDVLAKKYAR | 3262 | KDSERPS |
| clonotype 168 | 2876 | GFTFSGS | 3005 | RSKANSYA | 3134 | SGDVLAKKYAR | 3263 | KDSERPS |
| clonotype 169 | 2877 | GFTFSSY | 3006 | SSSSSY | 3135 | SGDALPKKYAY | 3264 | EDSKRPS |
| clonotype 170 | 2878 | GYTLTEL | 3007 | DPEDGE | 3136 | SGDALPKKYAY | 3265 | EDSKRPS |
| clonotype 171 | 2879 | GYTLTEL | 3008 | DPEDGE | 3137 | QGDSLRSYYAS | 3266 | GKNNRPS |

TABLE 13-continued

VH-CDR1, VH-CDR2, VL-CDR1, and VL-CDR2 Sequences for Anti-
CD131 Antibodies

| clono-type_id | SEQ ID NO | HCDR1 AA | SEQ ID NO | HCDR2 AA | SEQ ID NO | LCDR1 AA | SEQ ID NO | LCDR2 AA |
|---|---|---|---|---|---|---|---|---|
| clonotype 172 | 2880 | GFTFSSY | 3009 | SSSSST | 3138 | SGDALPKKYAY | 3267 | EDSKRPS |
| clonotype 173 | 2881 | GFTFSNA | 3010 | KSKTDGGT | 3139 | SGDALPKKYAY | 3268 | EDSKRPS |
| clonotype 174 | 2882 | GFTFSSY | 3011 | SSSSSY | 3140 | ASSTGAVTSGYY PN | 3269 | STSNKHS |
| clonotype 175 | 2883 | GFTFSSY | 3012 | SGSGGS | 3141 | TGTSSDVGGYNY VS | 3270 | EVSKRPS |
| clonotype 176 | 2884 | GGSISSSD | 3013 | NHSGT | 3142 | TGSSSNIGAGYD VH | 3271 | DNNNRPS |
| clonotype 178 | 2885 | GGSFSGY | 3014 | NHSGS | 3143 | QGDSLRNYYAS | 3272 | GKNNRPS |
| clonotype 179 | 2886 | GFTFSSY | 3015 | KQDGSE | 3144 | QGDSLRSYYAS | 3273 | GKNNRPS |
| clonotype 180 | 2887 | GFSLSTSGV | 3016 | YWNDD | 3145 | QGDSLRSYYAS | 3274 | GKNNRPS |
| clonotype 181 | 2888 | GYTFTSY | 3017 | SAYNGN | 3146 | SGDALPKKYAY | 3275 | EDSKRPS |
| clonotype 182 | 2889 | GFTFSRY | 3018 | NTAGD | 3147 | QGDNLRNYSVS | 3276 | GKNNRPS |
| clonotype 183 | 2890 | GFTFSSS | 3019 | YTTGD | 3148 | SGDALPKKYAY | 3277 | EDSKRPS |
| clonotype 184 | 2891 | GFTFSSY | 3020 | SSSSST | 3149 | SGDALPKKYAY | 3278 | EDSKRPS |
| clonotype 185 | 2892 | GFTFSSY | 3021 | SGSGGS | 3150 | SGDALPKKYAY | 3279 | EDSKRPS |
| clonotype 186 | 2893 | GFTFSSY | 3022 | SYDGSN | 3151 | QGDSLRSYYAS | 3280 | GKNNRPS |
| clonotype 187 | 2894 | GFTFSDY | 3023 | SSSGST | 3152 | GGNNIGSKSVH | 3281 | YDSDRPS |
| clonotype 188 | 2895 | GFTFSEY | 3024 | NSDGSR | 3153 | QGDSLRSYYAN | 3282 | GKNNRPS |
| clonotype 189 | 2896 | GFTFSSY | 3025 | NSDGSG | 3154 | QGDSLRTYYAS | 3283 | GKNNRPS |
| clonotype 190 | 2897 | GFTFDDY | 3026 | SWNSGS | 3155 | SGDALPKKYAY | 3284 | EDSKRPS |
| clonotype 191 | 2898 | GFTFSDY | 3027 | SHSGTT | 3156 | ASSTGAVTSGYY PN | 3285 | STSNKHS |
| clonotype 192 | 2899 | GFTFSSY | 3028 | NDSGYS | 3157 | TGTSSDVGGYNY VS | 3286 | EVIIRPS |
| clonotype 193 | 2900 | GFTFSSY | 3029 | GTAGD | 3158 | TGTSSDVGGYNY VS | 3287 | EVSNRPS |
| clonotype 194 | 2901 | GFTFSSY | 3030 | SSSSST | 3159 | TGTSSDVGGYNY VS | 3288 | EVSNRPS |
| clonotype 195 | 2902 | GYTLTEL | 3031 | DPEDGE | 3160 | SGDKLGDKYAC | 3289 | QDSKRPS |

TABLE 13-continued

VH-CDR1, VH-CDR2, VL-CDR1, and VL-CDR2 Sequences for Anti-CD131 Antibodies

| clono-type_id | SEQ ID NO | HCDR1 AA | SEQ ID NO | HCDR2 AA | SEQ ID NO | LCDR1 AA | SEQ ID NO | LCDR2 AA |
|---|---|---|---|---|---|---|---|---|
| clonotype 196 | 2903 | GFTFSSY | 3032 | SSSSSY | 3161 | SGDALPKKYAY | 3290 | EDSKRPS |
| clonotype 198 | 2904 | GFTFSNY | 3033 | WSDGSN | 3162 | GGNNIGSKSVH | 3291 | YDSDRPS |
| clonotype 199 | 2905 | GFTFSNA | 3034 | KSKTDGGT | 3163 | SGDALPKKYAY | 3292 | EDSKRPS |
| clonotype 200 | 2906 | GYSFTSY | 3035 | YPGDSD | 3164 | SGDALPKKYAY | 3293 | EDSKRPS |
| clonotype 201 | 2907 | GFTFSSY | 3036 | KQDGSE | 3165 | ASSTGAVTSGYYPN | 3294 | STSNKHS |
| clonotype 202 | 2908 | GFSLSTSGV | 3037 | YWNDD | 3166 | TGTSSDVGGYNYVS | 3295 | DVSKRPS |
| clonotype 203 | 2909 | GYTFSSY | 3038 | SAYNGN | 3167 | SGSSSNIGNNAVN | 3296 | HDVLLSS |
| clonotype 204 | 2910 | YMHWVRQ | 3039 | NYAQKF | 3168 | SGSSSNIGSNTVN | 3297 | SNNQRPS |
| clonotype 205 | 2911 | GYTFTDH | 3040 | NPNSGG | 3169 | SGSISNIGNNAVS | 3298 | YDDLLPS |
| clonotype 206 | 2912 | GFTFDDY | 3041 | SWNSGS | 3170 | TGTSSDVGGYNYVS | 3299 | EVSKRPS |
| clonotype 207 | 2913 | GGSITSSN | 3042 | YHSGN | 3171 | SGSSSNIGAGYDVH | 3300 | GNRNRPS |
| clonotype 209 | 2914 | GFTFSSY | 3043 | SSSSSY | 3172 | SGDVLAKKYAR | 3301 | KDSERPS |
| clonotype 210 | 2915 | GYTFTSY | 3044 | NTNTGN | 3173 | SGDKLGDKYAC | 3302 | QDSKRPS |
| clonotype 211 | 2916 | GFTFSSY | 3045 | SSSSSY | 3174 | QGDSLRSYYAS | 3303 | GKNNRPS |
| clonotype 212 | 2917 | GYTLTEL | 3046 | DPEDGE | 3175 | GGNNIGSKSVH | 3304 | YDSDRPS |
| clonotype 213 | 2918 | GYTVTRH | 3047 | NTNTGT | 3176 | QGDSLRSYYAS | 3305 | GKNNRPS |
| clonotype 214 | 2919 | GYAFRGQ | 3048 | RPNSGD | 3177 | QGDSLRSYYAS | 3306 | GKNNRPS |
| clonotype 215 | 2920 | GFTFSDS | 3049 | RGKPNTYA | 3178 | TGTSSDVGAYNYVS | 3307 | DVSKRPS |
| clonotype 217 | 2921 | GFSLSTSGV | 3050 | YWNDD | 3179 | SGDKLGDKYAC | 3308 | QDSKRPS |
| clonotype 218 | 2922 | GYTFTSY | 3051 | SAYNGN | 3180 | SGDKLGDKYAC | 3309 | QDSKRPS |
| clonotype 219 | 2923 | GFTFDDY | 3052 | SWNSGS | 3181 | SGDKLGDKYAC | 3310 | QDSKRPS |
| clonotype 220 | 2924 | GFTFDDY | 3053 | SRNSGS | 3182 | GENNIVNKNVH | 3311 | RDGNRPS |
| clonotype 223 | 2925 | GFTFSNA | 3054 | KSKTDGGT | 3183 | SGDALPKKYAY | 3312 | EDSKRPS |
| clonotype 225 | 2926 | GDSVSSNSA | 3055 | YYRSKWY | 3184 | SGDALPKKYAY | 3313 | EDSKRPS |
| clonotype 226 | 2927 | GYTFTRN | 3056 | DTHTGN | 3185 | SGSSSNIERTAVN | 3314 | SNDQRPL |

TABLE 13-continued

VH-CDR1, VH-CDR2, VL-CDR1, and VL-CDR2 Sequences for Anti-
CD131 Antibodies

| clono-type_id | SEQ ID NO | HCDR1 AA | SEQ ID NO | HCDR2 AA | SEQ ID NO | LCDR1 AA | SEQ ID NO | LCDR2 AA |
|---|---|---|---|---|---|---|---|---|
| clonotype 228 | 2928 | GYTFTTY | 3057 | SAYNGN | 3186 | TGNSSNIGADYDVQ | 3315 | ANIIRPS |
| clonotype 230 | 2929 | GFTFSSY | 3058 | KQDGSE | 3187 | SGDALPKKYAY | 3316 | EDSKRPS |
| clonotype 232 | 2930 | GYTFTSY | 3059 | SAYNGN | 3188 | SGDALPKKYAY | 3317 | EDSKRPS |
| clonotype 234 | 2931 | GFTFSNA | 3060 | KSKTDGGT | 3189 | QGDSLRSYYAS | 3318 | GKNNRPS |
| clonotype 236 | 2932 | GDSVSSNSA | 3061 | YYRSKWY | 3190 | SGDALPKKYAY | 3319 | EDSKRPS |
| clonotype 242 | 2933 | GFTFSTY | 3062 | SSRSSY | 3191 | SGDALPKKYAY | 3320 | EDSKRPS |
| clonotype 245 | 2934 | GYSFTGY | 3063 | NPNSGG | 3192 | QGDSLRSYYAS | 3321 | GKNNRPS |
| clonotype 247 | 2935 | GGSISSSSY | 3064 | YYSGS | 3193 | SGDALPKKYAY | 3322 | EDSKRPS |
| clonotype 248 | 2936 | GDSVSSNSA | 3065 | YYRSKWY | 3194 | GGNNIGSKSVH | 3323 | YDSDRPS |
| clonotype 249 | 2937 | GDSVSSNSA | 3066 | YYRSKWY | 3195 | SGDALPKKYAY | 3324 | EDSKRPS |
| clonotype 251 | 2938 | GGSFSGH | 3067 | NHSGF | 3196 | TGTSSDVGVYNYVS | 3325 | EVSNRPS |
| clonotype 252 | 2939 | GDSVSSNSA | 3068 | YYRSKWY | 3197 | TGTSSDVGGYNYVS | 3326 | EVSNRPS |
| clonotype 255 | 2940 | GFIFSSY | 3069 | SGSSSF | 3198 | QGDSLRSYYAS | 3327 | GKNNRPS |
| clonotype 261 | 2941 | GFDFTNA | 3070 | KSKTDGGS | 3199 | TGSSSNIGAGYAVH | 3328 | GNINRPS |
| clonotype 262 | 2942 | RFTFSSA | 3071 | KTKTEGGT | 3200 | SCSGSSSNIGAGYA | 3329 | IYGNLNR |
| clonotype 263 | 2943 | GGSISSSSY | 3072 | YYSGS | 3201 | TLRSGINVGTYRIY | 3330 | YKSDSDKQQGS |
| clonotype 264 | 2944 | GGSISSSSY | 3073 | YYSGS | 3202 | SGDKLGDKYAC | 3331 | QDSKRPS |
| clonotype 266 | 2945 | GGSFSGY | 3074 | NHSGS | 3203 | GGNNIGSKSVH | 3332 | YDSDRPS |
| clonotype 269 | 2946 | GGSISSSSY | 3075 | YYSGS | 3204 | SGDALPKKYAY | 3333 | EDSKRPS |
| clonotype 270 | 2947 | GGSFSGY | 3076 | NHSGS | 3205 | SGDKLGDKYAC | 3334 | QDSKRPS |
| clonotype 272 | 2948 | GYTFTSY | 3077 | NPKNGY | 3206 | TGSSSNIGAGYDVH | 3335 | GNSNRPS |

TABLE 14

| | | | | | | | |
|---|---|---|---|---|---|---|---|
| | | | | VH-CDR1, VH-CDR2, VL-CDR1, and VL-CDR2 Sequences for EPOR/CD131 Binders | | | |
| clono-type_id | SEQ ID NO | HCDR1 AA | SEQ ID NO | HCDR1 AA | SEQ ID NO | LCDR1 AA | SEQ ID NO | LCDR2 AA |

| clono-type_id | SEQ ID NO | HCDR1 AA | SEQ ID NO | HCDR1 AA | SEQ ID NO | LCDR1 AA | SEQ ID NO | LCDR2 AA |
|---|---|---|---|---|---|---|---|---|
| clonotype 7 | 3336 | GYTFTSY | 3472 | NPNSGN | 3608 | SGDKLGDKYAC | 3744 | QDSKRPS |
| clonotype 9 | 3337 | GGTFSSY | 3473 | IPIFGT | 3609 | TGTSSDVGGYNYVS | 3745 | DVSKRPS |
| clonotype 14 | 3338 | GGSISSSSY | 3474 | YYSGS | 3610 | TGTSSDVGGYNYVS | 3746 | DVSKRPS |
| clonotype 15 | 3339 | GFTFSSY | 3475 | SSSSTY | 3611 | TGTSSDVGGYNYVS | 3747 | EVSNRPS |
| clonotype 17 | 3340 | GFTFSSY | 3476 | GTAGD | 3612 | GGNNIGSKNVH | 3748 | RDSNRPS |
| clonotype 19 | 3341 | GFTFSDY | 3477 | SSSGST | 3613 | TGTSSDVGGYNYVS | 3749 | EVSNRPS |
| clonotype 22 | 3342 | GFTFSTD | 3478 | SGSSSY | 3614 | SGDALPKKYAY | 3750 | EDSKRPS |
| clonotype 29 | 3343 | GFTVSSN | 3479 | YSGGS | 3615 | TGTSSDVGGYNYVS | 3751 | EVSKRPS |
| clonotype 32 | 3344 | GGSISSSY | 3480 | YYSGS | 3616 | TLSSEHSTYTIE | 3752 | VKSDGSHSKGD |
| clonotype 38 | 3345 | GYTFTSY | 3481 | SAYNGN | 3617 | GGNNIGSKSVH | 3753 | YDSDRPS |
| clonotype 42 | 3346 | GFTFSSY | 3482 | KQDGSE | 3618 | SGDKLGDKYAC | 3754 | QDSKRPS |
| clonotype 43 | 3347 | GYTFTSY | 3483 | NPNSGN | 3619 | SGDKLGDKYAC | 3755 | QDSKRPS |
| clonotype 44 | 3348 | GETFSSY | 3484 | GTAGD | 3620 | GGNNIGSKNVH | 3756 | RDSNRPS |
| clonotype 45 | 3349 | GFTFSSY | 3485 | SSSSSY | 3621 | SGDVLAKKYAR | 3757 | KDSERPS |
| clonotype 56 | 3350 | GFTFSSY | 3486 | SSSSSY | 3622 | SGDALPKKYAY | 3758 | EDSKRPS |
| clonotype 57 | 3351 | GYTFISY | 3487 | NTNTGN | 3623 | GSSTGAVTSGHYPY | 3759 | DTSNKHS |
| clonotype 65 | 3352 | GFTVSSN | 3488 | YSGGS | 3624 | TGTSSDVGGYNYVS | 3760 | EVSNRPS |
| clonotype 68 | 3353 | GFTFSSY | 3489 | SSSSSY | 3625 | TGTSSDVGGYNYVS | 3761 | EVSKRPS |
| clonotype 70 | 3354 | GFTVSSN | 3490 | YSGGS | 3626 | TGSSSNIGAGYDVH | 3762 | GNSNRPS |
| clonotype 72 | 3355 | GDSVSSNSA | 3491 | YYRSKWY | 3627 | TGTSSDVGGYNYVS | 3763 | DVSKRPS |
| clonotype 74 | 3356 | GYSFSSY | 3492 | YPGDSD | 3628 | EGDNIGSESVH | 3764 | FDSDRPS |
| clonotype 215 | 3357 | GFTFSSY | 3493 | NSDGSS | 3629 | TGTSSDVGGYNYVS | 3765 | EVSNRPS |
| clonotype 216 | 3358 | GFTFSSY | 3494 | KQDGSE | 3630 | SGDALPKKYAY | 3766 | EDSKRPS |
| clonotype 219 | 3359 | GGSISSY | 3495 | YYSGS | 3631 | SGDVLAKKYAR | 3767 | KDSERPS |
| clonotype 221 | 3360 | GFTFINA | 3496 | KSKTDGGT | 3632 | SADALPNQYAY | 3768 | KDSERPS |

TABLE 14-continued

| VH-CDR1, VH-CDR2, VL-CDR1, and VL-CDR2 Sequences for EPOR/CD131 Binders | | | | | | | |
| clono-type_id | SEQ ID NO | HCDR1 AA | SEQ ID NO | HCDR1 AA | SEQ ID NO | LCDR1 AA | SEQ ID NO | LCDR2 AA |
| --- | --- | --- | --- | --- | --- | --- | --- | --- |
| clonotype 223 | 3361 | GFTFSNA | 3497 | KSKTDGGT | 3633 | SADALSKQYAY | 3769 | KDSERPS |
| clonotype 224 | 3362 | GFTFSNA | 3498 | KSKTDGGT | 3634 | SGDALPKKYAY | 3770 | EDSKRPS |
| clonotype 225 | 3363 | GYTFTSY | 3499 | SAYNGN | 3635 | TGTSSDVGGYNYVS | 3771 | EVSNRPS |
| clonotype 226 | 3364 | GFTFSTY | 3500 | SGGGGS | 3636 | TGTSSDVGGYNYVS | 3772 | EVSNRPS |
| clonotype 228 | 3365 | GFTFSSY | 3501 | GTAGD | 3637 | SGDALPKKYAY | 3773 | EDSKRPS |
| clonotype 229 | 3366 | GFTFSRY | 3502 | NQDGSE | 3638 | TGTSSDVGGYDYVS | 3774 | GVSNRPS |
| clonotype 230 | 3367 | GFTFSRC | 3503 | GAAGD | 3639 | TLRSGINVGTYRIY | 3775 | YKSDSDKQQGS |
| clonotype 231 | 3368 | GFTFINY | 3504 | WYDGSN | 3640 | SGDVLAKKYAR | 3776 | KDSERPS |
| clonotype 232 | 3369 | GFTFSSY | 3505 | NSDGSS | 3641 | SGDVLAKKYAR | 3777 | KDSERPS |
| clonotype 233 | 3370 | GFTFDDY | 3506 | SWNSGS | 3642 | SGDALPKKYAY | 3778 | EDSKRPS |
| clonotype 234 | 3371 | GYTFTSY | 3507 | SAYNGN | 3643 | SGDALPKKYAY | 3779 | EDSKRPS |
| clonotype 235 | 3372 | GYTFTSY | 3508 | NPSGGS | 3644 | QGDSLRSYYAS | 3780 | GKNNRPS |
| clonotype 236 | 3373 | GFTFSSY | 3509 | GTAGD | 3645 | QGDSLRSYYAS | 3781 | GKNNRPS |
| clonotype 237 | 3374 | GFTFSSY | 3510 | SGSGGS | 3646 | SGDALPKKYAY | 3782 | EDSKRPS |
| clonotype 238 | 3375 | GFTFSSY | 3511 | WYDGSN | 3647 | SGDALPKKYAY | 3783 | EDSKRPS |
| clonotype 239 | 3376 | GFSFSSH | 3512 | SGISNY | 3648 | TGTNNDVGYYNYVS | 3784 | DVIKRPS |
| clonotype 240 | 3377 | GFTFSSY | 3513 | SGSGGN | 3649 | TGTSSDVGGYNYVS | 3785 | EVSKRPS |
| clonotype 241 | 3378 | GYTFTSY | 3514 | NPSGGT | 3650 | TGTSSDVGNYNYVS | 3786 | EVIYRPS |
| clonotype 242 | 3379 | GFTFSSY | 3515 | KQDGSE | 3651 | TGSSSNIGAGYDVH | 3787 | GNSNRPS |
| clonotype 243 | 3380 | GYTFTSY | 3516 | SAYNGN | 3652 | TGTSSDVGGYNYVS | 3788 | DVSKRPS |
| clonotype 244 | 3381 | GYTFTNY | 3517 | SAYNGN | 3653 | TGTSSDVGGYNYVS | 3789 | DVSKRPS |
| clonotype 246 | 3382 | GFTFSSY | 3518 | SSSSST | 3654 | QGDSLRSYYAS | 3790 | GKNNRPS |
| clonotype 247 | 3383 | GFTFSSY | 3519 | GTAGD | 3655 | SGEALPKKYAY | 3791 | KDSERPS |
| clonotype 249 | 3384 | GYTFTSY | 3520 | IPNSGN | 3656 | TGTSSDVGGYNYVS | 3792 | EVSHRPS |

TABLE 14-continued

| | | | | | | | |
|---|---|---|---|---|---|---|---|
| | | | VH-CDR1, VH-CDR2, VL-CDR1, and VL-CDR2 Sequences for EPOR/CD131 Binders | | | | |
| clono- type_id | SEQ ID NO | HCDR1 AA | SEQ ID NO | HCDR1 AA | SEQ ID NO | LCDR1 AA | SEQ ID NO | LCDR2 AA |
| clonotype 250 | 3385 | GYTFTSY | 3521 | NPSGGS | 3657 | TGTSSDVGGYNY VS | 3793 | EVSNRPS |
| clonotype 251 | 3386 | GFTFSNA | 3522 | KSKTDGGT | 3658 | TGTSSDVGGYNY VS | 3794 | DVTTRPS |
| clonotype 252 | 3387 | GFTFSNY | 3523 | WYDGNN | 3659 | TGTSSDVGGYNY VS | 3795 | EVSNRPS |
| clonotype 253 | 3388 | GFTFSSY | 3524 | WYDGSN | 3660 | TGTSSDVGGYNY VS | 3796 | EVSNRPS |
| clonotype 254 | 3389 | GFTFDDY | 3525 | NWNGGS | 3661 | TGTSSDVGGYNY VS | 3797 | EVSKRPS |
| clonotype 255 | 3390 | GFTFSSY | 3526 | SSSSSY | 3662 | TGTSSDVGGYNY VS | 3798 | EVSKRPS |
| clonotype 256 | 3391 | GFTFSSY | 3527 | SGSGGS | 3663 | TGTSSDVGGYNY VS | 3799 | EVSNRPS |
| clonotype 259 | 3392 | GFTFSSY | 3528 | GTAGD | 3664 | SGDKLGDKYAC | 3800 | QDSKRPS |
| clonotype 260 | 3393 | GFPFDDF | 3529 | NWNGGT | 3665 | SGDVLAKKYAR | 3801 | KDSERPS |
| clonotype 262 | 3394 | GFSISIN | 3530 | SSSSTY | 3666 | SGDALPKKYAY | 3802 | EDSKRPS |
| clonotype 264 | 3395 | GFTFSSY | 3531 | NSDGSS | 3667 | QGDSLRSYYAS | 3803 | GKNNRPS |
| clonotype 265 | 3396 | GFTFSTY | 3532 | SSSSTY | 3668 | TGTSSDVGGYNY VS | 3804 | EVSNRPS |
| clonotype 266 | 3397 | GFTFSSY | 3533 | SGSGGS | 3669 | TGSSSNIGAGYD VH | 3805 | GNSNRPS |
| clonotype 270 | 3398 | GYTFTTY | 3534 | SGYSGY | 3670 | SRDKLGDKYAC | 3806 | QDSKRPS |
| clonotype 271 | 3399 | GFTFSSY | 3535 | SRSSGT | 3671 | SGDKLGDRYAC | 3807 | QGSKRPS |
| clonotype 272 | 3400 | GFTFNRY | 3536 | SSSSDT | 3672 | QGDSLRSYYAS | 3808 | GKNNRPS |
| clonotype 273 | 3401 | GGSISSSN | 3537 | YHSGS | 3673 | SGDKLENKYTC | 3809 | QDNKRPS |
| clonotype 274 | 3402 | GFTFSIY | 3538 | NLDGSE | 3674 | QGDNIRNYYAS | 3810 | GKNNRPS |
| clonotype 275 | 3403 | GFTFSGY | 3539 | KHDGSE | 3675 | QGDSLRRYYAS | 3811 | GKDNRPS |
| clonotype 276 | 3404 | GYTFTTY | 3540 | SAFNGN | 3676 | QGDSLRSYYAS | 3812 | GKNNRPS |
| clonotype 277 | 3405 | GFTFSSY | 3541 | GTAGD | 3677 | SGDALPKKYAY | 3813 | EDSKRPS |
| clonotype 278 | 3406 | GFTFSNA | 3542 | KSKTDGGT | 3678 | SGDALPKKYAY | 3814 | EDSKRPS |
| clonotype 279 | 3407 | GFTFSSY | 3543 | SGGGGS | 3679 | SGDALPKKYAY | 3815 | EDSKRPS |
| clonotype 280 | 3408 | GFTFSSY | 3544 | WYDGSN | 3680 | SGDALPKKYAY | 3816 | EDIKRPS |
| clonotype 281 | 3409 | GFTFSSY | 3545 | SSSSSY | 3681 | TGTSSDVGGYNY VS | 3817 | DVSKRPS |

TABLE 14-continued

VH-CDR1, VH-CDR2, VL-CDR1, and VL-CDR2 Sequences for
EPOR/CD131 Binders

| clono-type_id | SEQ ID NO | HCDR1 AA | SEQ ID NO | HCDR1 AA | SEQ ID NO | LCDR1 AA | SEQ ID NO | LCDR2 AA |
|---|---|---|---|---|---|---|---|---|
| clonotype 282 | 3410 | GFTFSSY | 3546 | SSSSSY | 3682 | TGTSSDVGGYNY VS | 3818 | DVSKRPS |
| clonotype 283 | 3411 | GYTFTGY | 3547 | NPNSGG | 3683 | TGTSSDVGGYNY VS | 3819 | EVSKRPS |
| clonotype 284 | 3412 | GFTFSNA | 3548 | KSKTDGGT | 3684 | TGTSSDVGGYNY VS | 3820 | EVSNRPS |
| clonotype 286 | 3413 | GYTFTGY | 3549 | NPNSGG | 3685 | SGDKLGDKYAC | 3821 | QDSKRPS |
| clonotype 287 | 3414 | GYTFTSY | 3550 | NPNSGN | 3686 | SGDKLGDKYAC | 3822 | QDSKRPS |
| clonotype 288 | 3415 | GFTFSNA | 3551 | KSKTDGGT | 3687 | SGDVLAKKYAR | 3823 | KDSERPS |
| clonotype 289 | 3416 | GFTFSGY | 3552 | KQDGSD | 3688 | SGDALPQKYAF | 3824 | EDSERPS |
| clonotype 290 | 3417 | GYTFTSY | 3553 | NPNSGN | 3689 | SGDALPKKYAY | 3825 | EDSKRPS |
| clonotype 291 | 3418 | GFTFSSY | 3554 | WYDGSN | 3690 | SGDALPKKYAY | 3826 | EDSKRPS |
| clonotype 292 | 3419 | GGSISDY | 3555 | SSRGR | 3691 | QGDSLRSYYAS | 3827 | GKNNRPS |
| clonotype 293 | 3420 | GFTFSSD | 3556 | GSSSSY | 3692 | QGDSLRNYYAS | 3828 | GKNNRPS |
| clonotype 294 | 3421 | GFTFSSY | 3557 | SSSSSY | 3693 | QGDSLRSYYAS | 3829 | GKNNRPS |
| clonotype 295 | 3422 | GFTFSSY | 3558 | SSSSSY | 3694 | SGDALPKKYAY | 3830 | EDSKRPS |
| clonotype 296 | 3423 | GYTFTSY | 3559 | SAYNGN | 3695 | QGDSLRSYYAS | 3831 | GKNNRPS |
| clonotype 297 | 3424 | GYTFTDH | 3560 | NPNSGG | 3696 | QGDSLRSYYAS | 3832 | GKNNRPS |
| clonotype 298 | 3425 | GYTFTGY | 3561 | NPNSGG | 3697 | QGDSLRSYYAS | 3833 | GKNNRPS |
| clonotype 300 | 3426 | GFTFSSY | 3562 | NSDGSN | 3698 | QGDSLRSYYAS | 3834 | GQNNRPS |
| clonotype 301 | 3427 | GDNVSSNSA | 3563 | YYRSKWY | 3699 | QGDSLRSYYAS | 3835 | GKNNRPS |
| clonotype 302 | 3428 | GYTFTSY | 3564 | SAYNGN | 3700 | SGSSSNIGYNAV N | 3836 | HDDLLPS |
| clonotype 303 | 3429 | GYTFTGY | 3565 | NPNSGG | 3701 | TGTSSDVGGYNY VS | 3837 | DVSKRPS |
| clonotype 304 | 3430 | GFTFSRY | 3566 | ISSTSY | 3702 | TGSSSNIGARYD VH | 3838 | DNSDRPS |
| clonotype 305 | 3431 | GFTFDEY | 3567 | SWNSGS | 3703 | TGSSSNIGAGYD VH | 3839 | GNSNRPS |
| clonotype 306 | 3432 | GFTFSSY | 3568 | WYDGSN | 3704 | TGSSSNIGAGYD VH | 3840 | GNSNRPS |
| clonotype 307 | 3433 | GFSISTSGV | 3569 | FWNDD | 3705 | TLRSGINVGTSR IY | 3841 | YKSDSDKHQ DS |

TABLE 14-continued

VH-CDR1, VH-CDR2, VL-CDR1, and VL-CDR2 Sequences for
EPOR/CD131 Binders

| clono-type_id | SEQ ID NO | HCDR1 AA | SEQ ID NO | HCDR1 AA | SEQ ID NO | LCDR1 AA | SEQ ID NO | LCDR2 AA |
|---|---|---|---|---|---|---|---|---|
| clonotype 308 | 3434 | GFTFDDY | 3570 | NWNGGS | 3706 | TLRSGINVGTYR IY | 3842 | YKSDSDKQQ GS |
| clonotype 309 | 3435 | GYTFTSY | 3571 | NPNSGN | 3707 | SGAKLGDKYAC | 3843 | QDRKRPS |
| clonotype 310 | 3436 | GFTFSSY | 3572 | SSSSSY | 3708 | SGDALPKKYAY | 3844 | EDSKRPS |
| clonotype 316 | 3437 | GFTESSY | 3573 | KQDGSE | 3709 | QGDSLRSYYAS | 3845 | GKNNRPS |
| clonotype 318 | 3438 | GDSVSSNSA | 3574 | YYRSKWY | 3710 | SGDKLGDKYAC | 3846 | QDSKRPS |
| clonotype 319 | 3439 | GFTFSTY | 3575 | SSSSTY | 3711 | QGDSLRSYYAS | 3847 | GKNNRPS |
| clonotype 320 | 3440 | GFSLSTSGM | 3576 | DWDDD | 3712 | SGDALPKKYAY | 3848 | EDSKRPS |
| clonotype 322 | 3441 | EFIFRSY | 3577 | SISSRT | 3713 | SGDALPKKYAY | 3849 | EDSKRPS |
| clonotype 323 | 3442 | GFTFSDY | 3578 | SSSGST | 3714 | SGDALPKKYAY | 3850 | EDSKRPS |
| clonotype 326 | 3443 | GFTFSSY | 3579 | SSSSST | 3715 | TGSSSNIGAGYD VH | 3851 | GNSNRPS |
| clonotype 327 | 3444 | GYTFTSY | 3580 | NPNSGN | 3716 | TLRSGINVGTYR IY | 3852 | YKSDSDKQQ GS |
| clonotype 328 | 3445 | GGSISSGGY | 3581 | YYSGS | 3717 | SGDKLGDKYAC | 3853 | QDSKRPS |
| clonotype 333 | 3446 | GFTFSSY | 3582 | KQDGSE | 3718 | QGDSLRRYYAS | 3854 | GKNNRPS |
| clonotype 339 | 3447 | GFTFSSY | 3583 | SSSSST | 3719 | SGDALPKKYAY | 3855 | EDSKRPS |
| clonotype 340 | 3448 | GFTFSSY | 3584 | SGSGGS | 3720 | SGDALPKKYAY | 3856 | EDSKRPS |
| clonotype 341 | 3449 | GFTFSSY | 3585 | WYDGSN | 3721 | GGNNIGGKSVH | 3857 | YNRDRPS |
| clonotype 342 | 3450 | GFTFRNA | 3586 | KTKTDGGA | 3722 | SGSNSNIGFNTV N | 3858 | SNNQRPS |
| clonotype 343 | 3451 | GYTFTSY | 3587 | SAYNGN | 3723 | TGTSSDVGGYNY VS | 3859 | EVSKRPS |
| clonotype 345 | 3452 | GDSVSSNSA | 3588 | YYRSKWY | 3724 | TGTSSDVGGYNY VS | 3860 | EVSKRPS |
| clonotype 349 | 3453 | GFTFSSY | 3589 | SSSSSY | 3725 | SGDKLGNKYAC | 3861 | QDNKRPS |
| clonotype 350 | 3454 | GFTFSSY | 3590 | SSSTST | 3726 | SGDKLGDKYAC | 3862 | QDIKRPS |
| clonotype 351 | 3455 | GFTFSNA | 3591 | KSKTDGGT | 3727 | SGDKLGDKYAC | 3863 | QDSMRPS |
| clonotype 352 | 3456 | GDSVSSNSA | 3592 | YYRSKWY | 3728 | SGDKLGDKYAC | 3864 | QDSKRPS |
| clonotype 356 | 3457 | GFTFSSY | 3593 | KQDGSE | 3729 | SGDALPKKYAY | 3865 | EDSKRPS |
| clonotype 358 | 3458 | GGSITTRSY | 3594 | YYSGN | 3730 | SGDALPKKYAY | 3866 | EDSKRPS |

TABLE 14-continued

VH-CDR1, VH-CDR2, VL-CDR1, and VL-CDR2 Sequences for
EPOR/CD131 Binders

| clono-type_id | SEQ ID NO | HCDR1 AA | SEQ ID NO | HCDR1 AA | SEQ ID NO | LCDR1 AA | SEQ ID NO | LCDR2 AA |
|---|---|---|---|---|---|---|---|---|
| clonotype 359 | 3459 | GGSISTRSY | 3595 | YYSGS | 3731 | SGSSSNIGINTVN | 3867 | FNNQRPS |
| clonotype 360 | 3460 | GGSFSGH | 3596 | NHSGF | 3732 | ASSTGAVTSGYYPN | 3868 | STSNKHS |
| clonotype 361 | 3461 | GGFLRGY | 3597 | NHSGS | 3733 | TGTSSDVGGYNYVS | 3869 | DVSKRPS |
| clonotype 363 | 3462 | GYIFSNY | 3598 | NPYNVN | 3734 | SGNLLAKKYPR | 387 | TDCERPS |
| clonotype 364 | 3463 | GFTFSSY | 3599 | SSSSSY | 3735 | QGDSLRSYYAS | 3871 | GKNNRPS |
| clonotype 365 | 3464 | GFTFTSY | 3600 | TPSGGT | 3736 | SGDALPKKYAY | 3872 | EDSKRPS |
| clonotype 366 | 3465 | GGSISTRSY | 3601 | FYSGS | 3737 | TGTSSDVGGYNYVS | 3873 | EVSKRPS |
| clonotype 367 | 3466 | GGSFSVY | 3602 | NHSGS | 3738 | SGSSSNIGSKTVN | 3874 | SSNQRPS |
| clonotype 368 | 3467 | GGSISSIIY | 3603 | YYSGS | 3739 | GENNIGSRNVH | 3875 | RDSDRPS |
| clonotype 369 | 3468 | GGSFSGY | 3604 | NHSGN | 3740 | QGDSLRSYYAS | 3876 | GKNNRPS |
| clonotype 370 | 3469 | GGSFSGY | 3605 | NHSGS | 3741 | SGDALPKKYAY | 3877 | EDSKRPS |
| clonotype 379 | 3470 | GYTFITY | 3606 | SAYNGN | 3742 | TGTSSDVGGYNYVS | 3878 | DVSKRPS |
| clonotype 380 | 3471 | GYTFITY | 3607 | SSYNGN | 3743 | TGTSSDVGGYNHVS | 3879 | DVSKRPS |

It is understood that, while particular embodiments have been illustrated and described, various modifications may be made thereto and are contemplated herein. It is also understood that the disclosure is not limited by the specific examples provided herein. The description and illustration of embodiments and examples of the disclosure herein are not intended to be construed in a limiting sense. It is further understood that all aspects of the disclosure are not limited to the specific depictions, configurations or relative proportions set forth herein, which may depend upon a variety of conditions and variables. Various modifications and variations in form and detail of the embodiments and examples of the disclosure will be apparent to a person skilled in the art. It is therefore contemplated that the disclosure also covers any and all such modifications, variations and equivalents.

SEQUENCE LISTING (3889 sequences)

SEQ ID NO: 1 - protein, 166 aa, Homo sapiens
APPRLICDSRVLERYLLEAKEAENITTGCAEHCSLNENITVPDTKVNFYAWKRMEVGQQAVEVWQGLALLSEAVLRGQALLVNSSQPWEPLQLHVDKAVSGLRSLTTLLRALGAQKEAISPPDAASAAPLRTITADTFRKLFRVYSNFLRGKLKLYTGEACRTGDR

SEQ ID NO: 2 - protein, 11 aa, synthetic construct
  source 1..11: note = Helix B
QEQLERALNSS

SEQ ID NO: 3 - DNA, 1662 bp, synthetic construct
  source 1..1662: mol_type = other DNA; note = cDNA for EPO
cctttcccagatagcacgctccgccagtcccaagggtgcgcaaccggctgcactcccctcccgcgacccagggcccgggagcagcccccatgacccacacgcacgtctgcagcagccccgctcacgccccggcgagcctcaacccaggcgtcctgcccctgctctgaccccgggtggcccctacccctggcgacccctcacgcacacagcctctcccccacccccacccgcgcacgcacacatgcagataacagccccgacccccggccagagccgcagagtccctgggccaccccggccgctcgctgcgctgcgccgcaccgcgctgtcctcccggagccggaccggggccaccgcgcccgctctgctccgacaccgcgccccctggacagccgccctctcctccaggcccgtggggctggccctgcaccgccgagcttcccgggatgagggcccccggtgtggtcacccggcgcgccccaggtcgctgagggaccccggccaggcgcggagatgggggtgcacgaatgtcctgcctggctgtggcttctcctgtccctgctgtcgctccctctgggcctcccagtcctgggcgccccaccacgcctcatctgtgacagccgagtcctggagaggtacctcttggaggccaaggaggccgagaatatcacgacgggctgtgctgaacactgcagcttgaatgagaatatcactgtcccagacaccaaagttaatttctatgcctggaagaggatggaggtcgggcagcaggccgtagaagtctggcagggcctggccctgctgtcggaagctgtcctgcggggccaggccctgttggtcaactcttcccagccgtgggagcccctgcagctgcatgtggataaagccgtcagtggccttcgcagcctcaccactctgcttcgggctctgggagcccagaaggaagccatctcccctccagatgcggcctcagctgctccactccgaacaatcactgctgacactttccgcaaactcttccgagtctactccaatttcctccggggaaagctgaagctgtacacaggggaggcctgcaggacaggggacagatgaccaggtgtgtccacctgggcatatccaccacctccctcaccaacattgcttgtgccacaccctcccccgccactcctgaaccccgtcgaggggctctcagctcagcgccagcctgtcccatggacactccagtgccagcaatgacatctcaggggccagaggaactgtccagagagcaactctgagatctaaggatgtcacagggccaacttgagggcccagagcaggaagcattcagagagcagctttaaactcagggacagagccatgctgggaagacgcctgagctcactcggcaccctgcaaaatttgatgccaggacacgctttggaggcgatttacctgttttcgcacctaccatcagggacaggatgacctggataacttaggtggcaagctgtgacttctccaggtctcacgggcatgggcactcccttggtggcaagagcccccttgacaccggggtggtgggaaccatgaagacaggatgggggctggcctctggctctcatggggtccaagttttgtgtattcttcaacctcattgacaagaactgaaaccaccaa

SEQ ID NO: 4 - RNA, 25 nt, Homo sapiens
  source 1..25: mol_type = mRNA; note = siRNA target
cttgaatgagaatatcactgtccca

SEQ ID NO: 5 - RNA, 25 nt, Homo sapiens
  source 1..25: mol_type = mRNA; note = siRNA target
gcagcttgaatgagaatatcactgt

SEQ ID NO: 6 - RNA, 25 nt, Homo sapiens
  source 1..25: mol_type = mRNA; note = siRNA target
gcatgtggataaagccgtcagtggc

SEQ ID NO: 7 - RNA, 25 nt, Homo sapiens
  source 1..25: mol_type = mRNA; note = siRNA target
ccgaacaatcactgctgacactttc

SEQ ID NO: 8 - RNA, 25 nt, Homo sapiens
  source 1..25: mol_type = mRNA; note = siRNA target
ctttccgcaaactcttccgagtcta

SEQ ID NO: 9 - RNA, 25 nt, Homo sapiens
  source 1..25: mol_type = mRNA; note = siRNA target
aaactcttccgagtctactccaatt

SEQ ID NO: 10 - RNA, 25 nt, Homo sapiens
  source 1..25: mol_type = mRNA; note = siRNA target
gagagcaactctgagatctaaggat

SEQ ID NO: 11 - RNA, 25 nt, Homo sapiens
  source 1..25: mol_type = mRNA; note = siRNA target
agagcaactctgagatctaaggatg

SEQ ID NO: 12 - RNA, 25 nt, Homo sapiens
  source 1..25: mol_type = mRNA; note = siRNA target
gagcaactctgagatctaaggatgt

SEQ ID NO: 13 - RNA, 25 nt, Homo sapiens
  source 1..25: mol_type = mRNA; note = siRNA target
caggaagcattcagagagcagcttt

SEQ ID NO: 14 - RNA, 25 nt, Homo sapiens
  source 1..25: mol_type = mRNA; note = siRNA target
aggaagcattcagagagcagcttta

SEQ ID NO: 15 - RNA, 25 nt, Homo sapiens
  source 1..25: mol_type = mRNA; note = siRNA target
gaagcattcagagagcagctttaaa

SEQ ID NO: 16 - RNA, 25 nt, Homo sapiens
  source 1..25: mol_type = mRNA; note = siRNA target
gagagcagctttaaactcagggaca

SEQ ID NO: 17 - RNA, 25 nt, Homo sapiens
  source 1..25: mol_type = mRNA; note = siRNA target
caggacacgctttggaggcgattta

SEQ ID NO: 18 - RNA, 25 nt, Homo sapiens
  source 1..25: mol_type = mRNA; note = siRNA target
catcagggacaggatgacctggata

SEQ ID NO: 19 - RNA, 25 nt, Homo sapiens
  source 1..25: mol_type = mRNA; note = siRNA target
gggacaggatgacctggataactta

SEQ ID NO: 20 - DNA, 2411 bp, synthetic construct
  source 1..2411: mol_type = other DNA; note = cDNA
ggtcagctgcgtccggcggaggcagctgctgacccagctgtggactgtgccgggggcgggggacggaggggcaggagccctgggctccccgtggcgggggctgtatcatggaccacctcggggcgtccctctggccccaggtcggctccctttgtctcctgctcgctggggccgcctgggcgcccccgcctaacctcccggaccccaagttcgagagcaaagcggccttgctggcggcccgggggcccgaagagcttctgtgcttcaccgagcggttggaggacttggtgtgtttctgggaggaagcggcgagcgctggggtgggcccgggcaactacagcttctcctaccagctcgaggatgagccatggaagctgtgtcgcctgcaccaggctcccacggctcgtggtgcggtgcgcttctggtgttcgctgcctacagccgacacgtcgagcttcgtgcccctagagttgcgcgtcacagcagcctccggcgctccgcgatatcaccgtgtcatccacatcaatgaagtagtgctcctagacgcccccgtggggctggtggcgcggttggctgacgagagcggccacgtagtgttgcgctggctcccgccgcctgagacacccatgacgtctcacatccgctacgaggtggacgtctcggccggcaacggcgcagggagcgtacagagggtggagatcctggagggccgcaccgagtgtgtgctgagcaacctgcggggccggacgcgctacaccttcgccgtccgcgcgcgtatggctgagccgagcttcggcggcttctggagcgcctggtcggagcctgtgtcgctgctgacgcctagcgacctggaccccctcatcctgacgctctccctcatcctcgtggtcatcctggtgctgctgaccgtgctcgcgctgctctcccaccgccgggctctgaagcagaagatctggcctggcatcccgagcccagagagcgagtttgaaggcctcttcaccacccacaagggtaacttccagctgtggctgtaccagaatgatggctgcctgtggtggagcccctgcacccccttcacggaggacccacctgcttccctggaagtcctctcagagcgctgctgggggacgatgcaggcagtggagccggggacagatgatgagggccccctgctggagccagtgggcagtgagcatgcccaggatacctatctggtgctggacaaatggttgctgccccggaacccgcccagtgaggacctcccagggcctggtggcagtgtggacatagtggccatggatgaaggctcagaagcatcctcctgctcatctgctttggcctcgaagcccagcccagagggagcctctgctgccagctttgagtacactatcctggaccccagctcccagctcttgcgtccatggacactgtgccctgagctgccccctaccccaccccacctaaagtacctgtaccttgtggtatctgactctggcatctcaactgactacagctcaggggactcccagggagcccaagggggcttatccgatggcccctactccaacccttatgagaacagccttatcccagccgctgagcctctgccccccagctatgtggcttgctcttaggacaccaggctgcagatgatcagggatccaatatgactcagagaaccagtgcagactcaagacttatggaacagggatggcgaggcctctctcaggagcaggggcattgctgattttgtctgcccaatccatcctgctcaggaaaccacaaccttgcagtatttttaaatatgtatagtttttttttgtatctatatatatatatacacatatgtatgtaagtttttctaccatgatttctacaaacaccctttaagtcccatcttcccctgggcataggccatagggatagaagttaaagttcttgagcttattcagaagctggatctgcaatctgaatgctactcataacataacaaaatagtatgttaaacagctcttaaatcttactggcttaccacattaaatgatttctctctcctaactcagctcaaatgggcagccatccatgggatgagtcagaggttcagactcttccagtctgtagctctaccttctcttagggtacttagatggatcccctgttctacaaactgccagtcagcaagggaagaaaaagggcagcaatgaccctcaatgggccatttgagggatctggcctggaaatgggcttcctctcttcttctcacacctcactggctggaaacagtcacatgaccccagtcacatgaaaggccaggaaacttagtttagctgtacacccaggaagggcaaagctgtttaagggccactagctagtctctgccactaataataataaaagtaattctgaatcag

SEQ ID NO: 21 - RNA, 25 nt, Homo sapiens
  source 1..25: mol_type = mRNA; note = siRNA target
caccgagcggttggaggacttggtg

SEQ ID NO: 22 - RNA, 25 nt, Homo sapiens
  source 1..25: mol_type = mRNA; note = siRNA target
cgaggatgagccatggaagctgtgt

SEQ ID NO: 23 - RNA, 25 nt, Homo sapiens
  source 1..25: mol_type = mRNA; note = siRNA target
atggaagctgtgtcgcctgcaccag

SEQ ID NO: 24 - RNA, 25 nt, Homo sapiens
  source 1..25: mol_type = mRNA; note = siRNA target
caccaggctcccacggctcgtggtg

SEQ ID NO: 25 - RNA, 25 nt, Homo sapiens
  source 1..25: mol_type = mRNA; note = siRNA target
atatcaccgtgtcatccacatcaat

SEQ ID NO: 26 - RNA, 25 nt, Homo sapiens
  source 1..25: mol_type = mRNA; note = siRNA target
acatcaatgaagtagtgctcctaga

SEQ ID NO: 27 - RNA, 25 nt, Homo sapiens
  source 1..25: mol_type = mRNA; note = siRNA target
atcaatgaagtagtgctcctagacg

SEQ ID NO: 28 - RNA, 25 nt, Homo sapiens
  source 1..25: mol_type = mRNA; note = siRNA target
cgtggggctggtggcgcggttggct

SEQ ID NO: 29 - RNA, 25 nt, Homo sapiens
  source 1..25: mol_type = mRNA; note = siRNA target
ctggagggccgcaccgagtgtgtgc

SEQ ID NO: 30 - RNA, 25 nt, Homo sapiens
  source 1..25: mol_type = mRNA; note = siRNA target
accacccacaagggtaacttccagc

SEQ ID NO: 31 - RNA, 25 nt, Homo sapiens
  source 1..25: mol_type = mRNA; note = siRNA target
cagaatgatggctgcctgtggtgga

SEQ ID NO: 32 - RNA, 25 nt, Homo sapiens
  source 1..25: mol_type = mRNA; note = siRNA target
agcgctgctgggggacgatgcaggc

SEQ ID NO: 33 - RNA, 25 nt, Homo sapiens
  source 1..25: mol_type = mRNA; note = siRNA target
gagggagcctctgctgccagctttg

SEQ ID NO: 34 - RNA, 25 nt, Homo sapiens
  source 1..25: mol_type = mRNA; note = siRNA target
cctgtaccttgtggtatctgactct

SEQ ID NO: 35 - RNA, 25 nt, Homo sapiens
  source 1..25: mol_type = mRNA; note = siRNA target
atctgactctggcatctcaactgac

SEQ ID NO: 36 - RNA, 25 nt, Homo sapiens
  source 1..25: mol_type = mRNA; note = siRNA target
tctggcatctcaactgactacagct

SEQ ID NO: 37 - RNA, 25 nt, Homo sapiens
  source 1..25: mol_type = mRNA; note = siRNA target
caggggactcccagggagcccaagg

SEQ ID NO: 38 - RNA, 25 nt, Homo sapiens
  source 1..25: mol_type = mRNA; note = siRNA target
agcctctgccccccagctatgtggc

SEQ ID NO: 39 - RNA, 25 nt, Homo sapiens
  source 1..25: mol_type = mRNA; note = siRNA target
ctcaagacttatggaacagggatgg

SEQ ID NO: 40 - RNA, 25 nt, Homo sapiens
  source 1..25: mol_type = mRNA; note = siRNA target
cttactggcttaccacattaaatga

SEQ ID NO: 41 - DNA, 4853 bp, synthetic construct
  source 1..4853: mol_type = other DNA; note = cDNA
actctgcctagaggctccagaagaagactggtctctcccaccacacagaggcctggaggaggcagaggccaggagggagaggtcccaagagcctgtgaaatgggtctggcctggctcccagctgggcaggaacacaggacttcaggacactaaggaccctgtcatgcccatggccagcacccaccagtgctggtgcctgcctgtccagagctgaccagggagatggtgctggcccaggggctgctctccatggccctgctggccctgtgctgggagcgcagcctggcaggggcagaagaaaccatcccgctgcagaccctgcgctgctacaacgactacaccagccacatcacctgcaggtgggcagacacccaggatgcccagcggctcgtcaacgtgaccctcattcgccgggtgaatgaggacctcctggagccagtgtcctgtgacctcagtgatgacatgccctggtcagcctgcccccatccccgctgcgtgcccaggagatgtgtcattccctgccagagttttgtcgtcactgacgttgactacttctcattccaaccagacaggcctctgggcacccggctcaccgtcactctgacccagcatgtccagcctcctgagcccagggacctgcagatcagcaccgaccaggaccacttcctgctgacctggagtgtggcccttgggagtccccagagccactggttgtccccaggggatctggagtttgaggtggtctacaagcggcttcaggactcttgggaggacgcagccatcctcctctccaacacctcccaggccaccctggggccagagcacctcatgcccagcagcacctacgtggcccgagtacggacccgcctggccccaggttctcggctctcaggacgtcccagcaagtggagcccagaggtttgctgggactcccagccaggggatgaggcccagccccagaacctggagtgcttctttgacggggccgccgtgctcagctgctcctgggaggtgaggaaggaggtggccagctcggtctcctttggcctattctacaagcccagcccagatgcaggggaggaagagtgctccccagtgctgagggaggggctcggcagcctccacaccaggcaccactgccagattcccgtgcccgaccccgcgacccacggccaatacatcgtctctgttcagccaaggagggcagagaaacacataaagagctcagtgaacatccagatggcccctccatccctcaacgtgaccaaggatggagacagctacagcctgcgctgggaaacaatgaaaatgcgatacgaacacatagaccacacatttgagatccagtacaggaaagacacggccacgtggaaggacagcaagaccgagaccctccagaacgcccacagcatggccctgccagccctggagccctccaccaggtactgggccagggtgagggtcaggacctcccgcaccggctacaacgggatctggagcgagtggagtgaggcgcgctcctgggacaccgagtcggtgctgcctatgtgggtgctggccctcatcgtgatcttcctcaccatcgctgtgctcctggccctccgcttctgtggcatctacgggtacaggctgcgcagaaagtgggaggagaagatccccaaccccagcaagagccacctgttccagaacgggagcgcagagctttggcccccaggcagcatgtcggccttcactagcgggagtcccccacaccaggggccgtggggcagccgcttccctgagctggagggggtgttccctgtaggattcggggacagcgaggtgtcacctctcaccatagaggaccccaagcatgtctgtgatccaccatctgggcctgacacgactccagctgcctcagatctacccacagagcagccccccagcccccagccaggcccgcctgccgcctcccacacacctgagaaacaggcttccagctttgacttcaatgggccctacctggggccgccccacagccgctccctacctgacatcctgggccagccggagcccccacaggagggtgggagccagaagtccccacctccagggtccctggagtacctgtgtctgcctgctggggggcaggtgcaactggtccctctggcccaggcgatgggaccaggacaggccgtggaagtggagagaaggccgagccagggggctgcagggagtccctccctggagtccgggggaggccctgcccctcctgctcttgggccaagggtgggaggacaggaccaaaaggacagccctgtggctatacccatgagctctggggacactgaggaccctggagtggcctctggttatgtctcctctgcagacctggtattcaccccaaactcaggggcctcgtctgtctccctagttccctctctgggcctcccctcagaccagacccccagcttatgtcctgggctggccagtggaccccctggagccccaggccctgtgaagtcagggtttgagggctatgtggagctccctccaattgagggccggtcccccaggtcaccaaggaacaatcctgtcccccctgaggccaaaagccctgtcctgaacccaggggaacgcccggcagatgtgtccccaacatccccacagcccgagggcctccttgtcctgcagcaagtgggcgactattgcttcctccccggcctggggcccggccctctctcgctccggagtaaaccttcttccccgggacccggtcctgagatcaagaacctagaccaggcttttcaagtcaagaagcccccaggccaggctgtgccccaggtgcccgtcattcagctcttcaaagccctgaagcagcaggactacctgtctctgcccccttgggaggtcaacaagcctggggaggtgtgttgagacccccaggcctagacaggcaaggggatggagagggcttgccttccctcccgcctgaccttcctcagtcatttctgcaaagccaaggggcagcctcctgtcaaggtagctagaggcctgggaaaggagatagccttgctccggcccccttgaccttcagcaaatcacttctctccctgcgctcacacagacacacacacacacacgtacatgcacacatttttcctgtcaggttaacttatttgtaggttctgcattattagaactttctagatatactcattccatctccccctcatttttttaatcaggtttccttgcttttgccatttttcttccttcttttttcactgatttattatgagagtggggctgaggtctgagctgagccttatcagactgagatgcggctggttgtgttgaggacttgtgtgggctgcctgtccccggcagtcgctgatgcacatgacatgattctcatctgggtgcagaggtgggaggcaccaggtgggcacccgtgggggttagggcttggaagagtggcacaggactgggcacgctcagtgaggctcagggaattcagactagcctcgattgtcactccgagaaatgggcatggtattgggggtcgggggggcggtgcaagggacgcacatgagagactgtttgggagcttctggggagccctgctagttgtctcagtgatgtctgtgggacctccagtcccttgagaccccacgtcatgtagagaagttaacggcccaagtggtgggcaggctggcgggacctggggaacatcaggagaggagtccagagcccacgtctactgcggaaaagtcaggggaaactgccaaacaaaggaaaatgccccaaaggcatatatgctttagggcctttggtccaaatggcccgggtggccactcttccagatagaccaggcaactctccctcccaccggccacagatgaggggctgctgatctatgcctgggcctgcaccagggattatggttcttttaaatctttgcctttcagatacaggaaaaataatggcattaaattgctttaatttgcattattttagttatccagtttgcacatatttttataggtatcttaggcatcgattggtattttttaactgggccaagcccattaaggtctttcttctgttgggtgctatcattttctgattaagtctttttgactattgacatacagtctttcacagatggtggagtgtttttcccccaaatctgttgtttgtcttataatgttgtatatgaggttttatggtgtatgaatatgaatgcttctgtaatgtcaaacagatccctagtaaactccttcttcacttttactgtcagatttacaaaggtcctcccattgcaaagcagtgtttgtcctaatttatatattgtttttctagttcattttgtgtttccaacttttcatgtaaaattttaattatttttgaatgtgtggatgtgagactgaggtgccttttggtactgaaattctttttccatgtacctgaagtgttacttttgtgatataggaaatccttgtatatatactttattggtccctaggcttcctattttgttaccttgctttctctatggcatccaccattttgattgttctacttttatgatatgttttcataagtggttaagcaagtattctcgttacttttgctcttaaatccctattcattacagcaatgttggtggtcaaagaaaatgataaacaacttgaatgttcaatggtcctgaaatacataacaacattttagtacattgtaaagtagaatcctctgttcataatgaacaagatgaaccaatgtggattagaaagaagtccgagatattaattccaaaatatccagacattgttaaagggaaaaaattgcaataaaatatttgtaacataaaa

SEQ ID NO: 42 - RNA, 25 nt, Homo sapiens
  source 1..25: mol_type = mRNA; note = siRNA target
ggctcgtcaacgtgaccctcattcg

SEQ ID NO: 43 - RNA, 25 nt, Homo sapiens
  source 1..25: mol_type = mRNA; note = siRNA target
cctggagccagtgtcctgtgacctc

SEQ ID NO: 44 - RNA, 25 nt, Homo sapiens
  source 1..25: mol_type = mRNA; note = siRNA target
gcccaggagatgtgtcattccctgc

SEQ ID NO: 45 - RNA, 25 nt, Homo sapiens
  source 1..25: mol_type = mRNA; note = siRNA target
gtcgtcactgacgttgactacttct

SEQ ID NO: 46 - RNA, 25 nt, Homo sapiens
  source 1..25: mol_type = mRNA; note = siRNA target
gacgttgactacttctcattccaac

SEQ ID NO: 47 - RNA, 25 nt, Homo sapiens
  source 1..25: mol_type = mRNA; note = siRNA target
ctccacaccaggcaccactgccaga

SEQ ID NO: 48 - RNA, 25 nt, Homo sapiens
  source 1..25: mol_type = mRNA; note = siRNA target
acccacggccaatacatcgtctctg

SEQ ID NO: 49 - RNA, 25 nt, Homo sapiens
  source 1..25: mol_type = mRNA; note = siRNA target
atggcccctccatccctcaacgtga

SEQ ID NO: 50 - RNA, 25 nt, Homo sapiens
  source 1..25: mol_type = mRNA; note = siRNA target
acgtgaccaaggatggagacagcta

SEQ ID NO: 51 - RNA, 25 nt, Homo sapiens
  source 1..25: mol_type = mRNA; note = siRNA target
gtgaccaaggatggagacagctaca

SEQ ID NO: 52 - RNA, 25 nt, Homo sapiens
  source 1..25: mol_type = mRNA; note = siRNA target
aaggatggagacagctacagcctgc

SEQ ID NO: 53 - RNA, 25 nt, Homo sapiens
  source 1..25: mol_type = mRNA; note = siRNA target
atgcgatacgaacacatagaccaca

SEQ ID NO: 54 - RNA, 25 nt, Homo sapiens
  source 1..25: mol_type = mRNA; note = siRNA target
cgatacgaacacatagaccacacat

SEQ ID NO: 55 - RNA, 25 nt, Homo sapiens
  source 1..25: mol_type = mRNA; note = siRNA target
gtgggtgctggccctcatcgtgatc

SEQ ID NO: 56 - RNA, 25 nt, Homo sapiens
  source 1..25: mol_type = mRNA; note = siRNA target
agatccccaaccccagcaagagcca

SEQ ID NO: 57 - RNA, 25 nt, Homo sapiens
  source 1..25: mol_type = mRNA; note = siRNA target
cggggacagcgaggtgtcacctctc

SEQ ID NO: 58 - RNA, 25 nt, Homo sapiens
  source 1..25: mol_type = mRNA; note = siRNA target
ctacccacagagcagccccccagcc

SEQ ID NO: 59 - RNA, 25 nt, Homo sapiens
  source 1..25: mol_type = mRNA; note = siRNA target
aaaggacagccctgtggctataccc

SEQ ID NO: 60 - RNA, 25 nt, Homo sapiens
  source 1..25: mol_type = mRNA; note = siRNA target
cctgagatcaagaacctagaccagg

SEQ ID NO: 61 - RNA, 25 nt, Homo sapiens
  source 1..25: mol_type = mRNA; note = siRNA target
tcaaagccctgaagcagcaggacta

SEQ ID NO: 62 - RNA, 25 nt, Homo sapiens
  source 1..25: mol_type = mRNA; note = siRNA target
gtcaaagaaaatgataaacaacttg

SEQ ID NO: 63 - protein, 14 aa, synthetic construct
CARKGELLGAFDIW

SEQ ID NO: 64 - protein, 14 aa, synthetic construct
CARKWELRDAFDIW

SEQ ID NO: 65 - protein, 15 aa, synthetic construct
CAREDYGDPGWFDPW

SEQ ID NO: 66 - protein, 11 aa, synthetic construct
CATLTGDGDYW

SEQ ID NO: 67 - protein, 15 aa, synthetic construct
CARDRSSSWYSFDYW

SEQ ID NO: 68 - protein, 16 aa, synthetic construct
CARDGITGTTFYFDYW

SEQ ID NO: 69 - protein, 12 aa, synthetic construct
CASIAAAGRDYW

SEQ ID NO: 70 - protein, 12 aa, synthetic construct
CAKAPELRFDYW

SEQ ID NO: 71 - protein, 12 aa, synthetic construct
CARNHYYYMDVW

SEQ ID NO: 72 - protein, 16 aa, synthetic construct
CARGELGIGYWYFDLW

SEQ ID NO: 73 - protein, 17 aa, synthetic construct
CARDTGITMVRGVFDYW

SEQ ID NO: 74 - protein, 15 aa, synthetic construct
CNGVYGGSSYFFDYW

SEQ ID NO: 75 - protein, 12 aa, synthetic construct
CARDETTIFDYW

SEQ ID NO: 76 - protein, 24 aa, synthetic construct
CARLGCNGTSCYTSWYYHFYMDVW

SEQ ID NO: 77 - protein, 18 aa, synthetic construct
CARDEDYYGSGSYSFDYW

SEQ ID NO: 78 - protein, 13 aa, synthetic construct
CARRGAARPFDYW

SEQ ID NO: 79 - protein, 14 aa, synthetic construct
CAHSNWNYGYFDLW

SEQ ID NO: 80 - protein, 14 aa, synthetic construct
CAKKDIVATHFDYW

SEQ ID NO: 81 - protein, 17 aa, synthetic construct
CTTADYDFWSGYYMDVW

SEQ ID NO: 82 - protein, 11 aa, synthetic construct [sequence omitted]

SEQ ID NO: 83 - protein, 16 aa, synthetic construct
CARGGDTAMVTVFDYW

SEQ ID NO: 84 - protein, 13 aa, synthetic construct
CARQINWGAIDYW

SEQ ID NO: 85 - protein, 14 aa, synthetic construct
CARQITATRGFDYW

SEQ ID NO: 86 - protein, 14 aa, synthetic construct
CARKWELRDTFDIW

SEQ ID NO: 87 - protein, 11 aa, synthetic construct
CASYGDFFDYW

SEQ ID NO: 88 - protein, 13 aa, synthetic construct
CARETELTVMDVW

SEQ ID NO: 89 - protein, 22 aa, synthetic construct
CTTDWEYYDFWSGYYSPYFDYW

SEQ ID NO: 90 - protein, 8 aa, synthetic construct [sequence omitted]

SEQ ID NO: 91 - protein, 8 aa, synthetic construct
CVRAFDYW

SEQ ID NO: 92 - protein, 7 aa, synthetic construct
CTTGANW

SEQ ID NO: 93 - protein, 9 aa, synthetic construct [sequence omitted]

SEQ ID NO: 94 - protein, 9 aa, synthetic construct
CARQIGDYW

SEQ ID NO: 95 - protein, 9 aa, synthetic construct
CHQTGEDYW

SEQ ID NO: 96 - protein, 8 aa, synthetic construct
CTTGGTHW

SEQ ID NO: 97 - protein, 10 aa, synthetic construct
CARRSFLDYW

SEQ ID NO: 98 - protein, 8 aa, synthetic construct
CTTGGTNW

SEQ ID NO: 99 - protein, 11 aa, synthetic construct [sequence omitted]

SEQ ID NO: 100 - protein, 11 aa, synthetic construct
CARGSSWFDYW

SEQ ID NO: 101 - protein, 9 aa, synthetic construct
CTLNWGDYW

SEQ ID NO: 102 - protein, 11 aa, synthetic construct
CARAADAFDIW

SEQ ID NO: 103 - protein, 12 aa, synthetic construct [sequence omitted]

SEQ ID NO: 104 - protein, 9 aa, synthetic construct
CTTDHPYYW

SEQ ID NO: 105 - protein, 9 aa, synthetic construct
CTTDHPYYW

SEQ ID NO: 106 - protein, 11 aa, synthetic construct
CALAVTGFDYW

SEQ ID NO: 107 - protein, 11 aa, synthetic construct [sequence omitted]

SEQ ID NO: 108 - protein, 12 aa, synthetic construct
CARDRGYSFDYW

SEQ ID NO: 109 - protein, 12 aa, synthetic construct
CARNHYYYLDVW

SEQ ID NO: 110 - protein, 13 aa, synthetic construct
CARVSPTGTTDYW

SEQ ID NO: 111 - protein, 10 aa, synthetic construct
CTARPLGDVW

SEQ ID NO: 112 - protein, 10 aa, synthetic construct
CTTDNGFDYW

SEQ ID NO: 113 - protein, 12 aa, synthetic construct
CARDLISSFDYW

SEQ ID NO: 114 - protein, 12 aa, synthetic construct
CARRIVGAFDYW

SEQ ID NO: 115 - protein, 12 aa, synthetic construct
CARGGWGTMDVW

SEQ ID NO: 116 - protein, 12 aa, synthetic construct [sequence omitted]

SEQ ID NO: 117 - protein, 13 aa, synthetic construct
CARDNWDSYFDYW

SEQ ID NO: 118 - protein, 12 aa, synthetic construct
CARTTVTHMDVW

SEQ ID NO: 119 - protein, 13 aa, synthetic construct
CARDWNYDAFDIW

SEQ ID NO: 120 - protein, 12 aa, synthetic construct
CARGDPGWFDPW

SEQ ID NO: 121 - protein, 13 aa, synthetic construct
CARENWNYWFDPW

SEQ ID NO: 122 - protein, 13 aa, synthetic construct
CARLRPGDSFDYW

SEQ ID NO: 123 - protein, 13 aa, synthetic construct
CARSPNWGLFDYW

SEQ ID NO: 124 - protein, 13 aa, synthetic construct
CARDRGATGFDYW

SEQ ID NO: 125 - protein, 13 aa, synthetic construct
CARESGELLGDYW

SEQ ID NO: 126 - protein, 14 aa, synthetic construct
CARYSGSYYYFDYW

SEQ ID NO: 127 - protein, 13 aa, synthetic construct
CARGIAAAGKDYW

SEQ ID NO: 128 - protein, 13 aa, synthetic construct
CARQDSNYVFDYW

SEQ ID NO: 129 - protein, 13 aa, synthetic construct
CARDHSAWSFDYW

SEQ ID NO: 130 - protein, 13 aa, synthetic construct
CARRRGSCSFDYW

SEQ ID NO: 131 - protein, 13 aa, synthetic construct
CARRSYANCFDYW

SEQ ID NO: 132 - protein, 13 aa, synthetic construct
CARDEQLVPFDIW

SEQ ID NO: 133 - protein, 14 aa, synthetic construct
CARDGAAAGDFQHW

SEQ ID NO: 134 - protein, 13 aa, synthetic construct [sequence omitted]

SEQ ID NO: 135 - protein, 13 aa, synthetic construct
CARDGQLWSFDYW

SEQ ID NO: 136 - protein, 14 aa, synthetic construct
CGRVVPIGNWFDPW

SEQ ID NO: 137 - protein, 13 aa, synthetic construct
CARDSNWGVFDYW

SEQ ID NO: 138 - protein, 13 aa, synthetic construct
CARDRLTGDLDYW

SEQ ID NO: 139 - protein, 14 aa, synthetic construct
CAREGDRSDAFAIW

SEQ ID NO: 140 - protein, 14 aa, synthetic construct
CARQQWLGYYFDYW

SEQ ID NO: 141 - protein, 14 aa, synthetic construct
CARDSNFLYYFDYW

SEQ ID NO: 142 - protein, 14 aa, synthetic construct
CARQITGTRGFDYW

SEQ ID NO: 143 - protein, 14 aa, synthetic construct
CARMGYSNYPFDYW

SEQ ID NO: 144 - protein, 14 aa, synthetic construct
CARGIPTTVTPDYW

SEQ ID NO: 145 - protein, 15 aa, synthetic construct
CARAGLLTGDAFDIW

SEQ ID NO: 146 - protein, 12 aa, synthetic construct
CITGTTFPFDYW

SEQ ID NO: 147 - protein, 13 aa, synthetic construct
CTKGGVGASFDYW

SEQ ID NO: 148 - protein, 14 aa, synthetic construct
CARGDYSNYYFDYW

SEQ ID NO: 149 - protein, 8 aa, synthetic construct
CARWEQPW

SEQ ID NO: 150 - protein, 14 aa, synthetic construct
CARRTGTTHYFDYW

SEQ ID NO: 151 - protein, 14 aa, synthetic construct
CARGLWLGLYFDYW

SEQ ID NO: 152 - protein, 14 aa, synthetic construct
CARFLGSSYYFDYW

SEQ ID NO: 153 - protein, 14 aa, synthetic construct
CARGGAAAGAFDIW

SEQ ID NO: 154 - protein, 14 aa, synthetic construct
CARAEWELLWFDPW

SEQ ID NO: 155 - protein, 14 aa, synthetic construct
CAHNYFYISGYFYW

SEQ ID NO: 156 - protein, 15 aa, synthetic construct
CAKDPLRVVNYMDVW

SEQ ID NO: 157 - protein, 14 aa, synthetic construct
CAQTGYNSWSFDYW

SEQ ID NO: 158 - protein, 15 aa, synthetic construct
CAREDAWNYGWFDPW

SEQ ID NO: 159 - protein, 15 aa, synthetic construct
CAREILWLGGYFDYW

SEQ ID NO: 160 - protein, 15 aa, synthetic construct [sequence omitted]

SEQ ID NO: 161 - protein, 15 aa, synthetic construct
CARERIAVAPPFDYW

SEQ ID NO: 162 - protein, 15 aa, synthetic construct
CARAGWELPEYFQHW

SEQ ID NO: 163 - protein, 15 aa, synthetic construct
CARGGDDYSNLFDYW

SEQ ID NO: 164 - protein, 15 aa, synthetic construct
CARTPLGIGRSFDLW

SEQ ID NO: 165 - protein, 13 aa, synthetic construct
CTTASTVTTGDYW

SEQ ID NO: 166 - protein, 11 aa, synthetic construct
CARERTEIDYW

SEQ ID NO: 167 - protein, 13 aa, synthetic construct
CTTGRYFDWFDYW

SEQ ID NO: 168 - protein, 13 aa, synthetic construct
CTTASGSYWFDPW

SEQ ID NO: 169 - protein, 15 aa, synthetic construct
CAKGNWNYGDAFDIW

SEQ ID NO: 170 - protein, 15 aa, synthetic construct
CARENYDFWSGFDPW

SEQ ID NO: 171 - protein, 11 aa, synthetic construct
CAREDRGFDYW

SEQ ID NO: 172 - protein, 15 aa, synthetic construct
CAKRAVVTDYYMDVW

SEQ ID NO: 173 - protein, 15 aa, synthetic construct
CARTSSWSYDAFDIW

SEQ ID NO: 174 - protein, 16 aa, synthetic construct
CARERGHTVTPYFDYW

SEQ ID NO: 175 - protein, 16 aa, synthetic construct
CARDGPQVGATDFDYW

SEQ ID NO: 176 - protein, 14 aa, synthetic construct
CTTEYSSSENFDYW

SEQ ID NO: 177 - protein, 16 aa, synthetic construct
CARDLGAARPRGFDYW

SEQ ID NO: 178 - protein, 16 aa, synthetic construct
CAKEGDSGYDSAFDIW

SEQ ID NO: 179 - protein, 16 aa, synthetic construct
CARVLNWNYGDAFDIW

SEQ ID NO: 180 - protein, 16 aa, synthetic construct
CARDPSIVGATAFDIW

SEQ ID NO: 181 - protein, 16 aa, synthetic construct
CARSHIVGVNGGFDYW

SEQ ID NO: 182 - protein, 16 aa, synthetic construct
CARDRYNWNYRAFDIW

SEQ ID NO: 183 - protein, 16 aa, synthetic construct
CARDLGRGTISWFDPW

SEQ ID NO: 184 - protein, 15 aa, synthetic construct
CTQTGYDSRWSFAYW

SEQ ID NO: 185 - protein, 16 aa, synthetic construct
CAREGQWRGRGWFALW

SEQ ID NO: 186 - protein, 16 aa, synthetic construct
CARERYFEDFHYMDVW

SEQ ID NO: 187 - protein, 16 aa, synthetic construct
CARSSWLQLTYYFDYW

SEQ ID NO: 188 - protein, 16 aa, synthetic construct
CAREGLQLGSNWFDPW

SEQ ID NO: 189 - protein, 16 aa, synthetic construct
CARNDILTGEDAFDIW

SEQ ID NO: 190 - protein, 16 aa, synthetic construct
CAKESIIVGATMFDYW

SEQ ID NO: 191 - protein, 16 aa, synthetic construct
CAKGIAALGYYYMDVW

SEQ ID NO: 192 - protein, 16 aa, synthetic construct
CAKRRITGSHNWFDPW

SEQ ID NO: 193 - protein, 16 aa, synthetic construct
CARGGTIFGVVNFDYW

SEQ ID NO: 194 - protein, 16 aa, synthetic construct
CLSRSGYSAHNDGDYW

SEQ ID NO: 195 - protein, 16 aa, synthetic construct
CTKEGLVVRPDWFDPW

SEQ ID NO: 196 - protein, 12 aa, synthetic construct
CARKGRDVFDIW

SEQ ID NO: 197 - protein, 16 aa, synthetic construct [sequence omitted]

SEQ ID NO: 198 - protein, 15 aa, synthetic construct
CTHTEYRNTWCVDYW

SEQ ID NO: 199 - protein, 15 aa, synthetic construct
CAHSPYTSGWPFDYW

SEQ ID NO: 200 - protein, 16 aa, synthetic construct
CARVSYSSSWSLFDYW

SEQ ID NO: 201 - protein, 16 aa, synthetic construct
CARIRGVGALDGFDFW

SEQ ID NO: 202 - protein, 17 aa, synthetic construct
CARPLDYGDYEGWFDPW

SEQ ID NO: 203 - protein, 17 aa, synthetic construct
CAREGRTNYFYYYMDVW

SEQ ID NO: 204 - protein, 17 aa, synthetic construct
CAKDITASGDYYYMDVW

SEQ ID NO: 205 - protein, 17 aa, synthetic construct
CARDRVYNWNDGAFDIW

SEQ ID NO: 206 - protein, 17 aa, synthetic construct
CAKDQRYNWNSWYFDLW

SEQ ID NO: 207 - protein, 17 aa, synthetic construct
CARDHGGVTTYNWFDPW

SEQ ID NO: 208 - protein, 17 aa, synthetic construct
CARDRMVRGVLDAFDIW

SEQ ID NO: 209 - protein, 17 aa, synthetic construct
CVRGYSSGWYNWYFDLW

SEQ ID NO: 210 - protein, 17 aa, synthetic construct
CARKVPGIAAAGAFDYW

SEQ ID NO: 211 - protein, 17 aa, synthetic construct
CARGGYGYNFWIRFDPW

SEQ ID NO: 212 - protein, 10 aa, synthetic construct
CASYWNFDYW

SEQ ID NO: 213 - protein, 18 aa, synthetic construct
CARVLGYSYGYRRWFDPW

SEQ ID NO: 214 - protein, 16 aa, synthetic construct
CTTEGSFNFYYFMDVW

SEQ ID NO: 215 - protein, 19 aa, synthetic construct
CARDPFYYDFSDYYYMDVW

SEQ ID NO: 216 - protein, 18 aa, synthetic construct
CAKNEARDYYGSGSFDYW

SEQ ID NO: 217 - protein, 18 aa, synthetic construct
CASLVGATDYYFYYMDVW

SEQ ID NO: 218 - protein, 14 aa, synthetic construct
CARKWELLDAFDIW

SEQ ID NO: 219 - protein, 18 aa, synthetic construct
CAREERDDYSNYGYFQHW

SEQ ID NO: 220 - protein, 14 aa, synthetic construct
CARGDWNYGVLDSW

SEQ ID NO: 221 - protein, 18 aa, synthetic construct
CARSGYNWNYDYYFMDVW

SEQ ID NO: 222 - protein, 19 aa, synthetic construct
CARDGCSSTSCYGNWFDPW

SEQ ID NO: 223 - protein, 15 aa, synthetic construct
CARVDFGIVGAIDYW

SEQ ID NO: 224 - protein, 19 aa, synthetic construct
CARDRDDFWSGYSPYFDYW

SEQ ID NO: 225 - protein, 19 aa, synthetic construct
CAREKYDILTGYSPYFDYW

SEQ ID NO: 226 - protein, 17 aa, synthetic construct
CTTDQVSGSYGDAFDIW

SEQ ID NO: 227 - protein, 19 aa, synthetic construct
CAKRAGSGTYYRGYYFDYW

SEQ ID NO: 228 - protein, 19 aa, synthetic construct
CAGTYYYDSSGYLNYMDVW

SEQ ID NO: 229 - protein, 11 aa, synthetic construct
CASEGPYFDYW

SEQ ID NO: 230 - protein, 19 aa, synthetic construct
CARAYCGGDCYYSNAFDAW

SEQ ID NO: 231 - protein, 17 aa, synthetic construct
CTTDRVTIFGLARMDVW

SEQ ID NO: 232 - protein, 20 aa, synthetic construct
CARDPTTIFGVVPYYYMDVW

SEQ ID NO: 233 - protein, 18 aa, synthetic construct
CTTDRDYYGSGSYYFDYW

SEQ ID NO: 234 - protein, 12 aa, synthetic construct
CAREDLIGNDYW

SEQ ID NO: 235 - protein, 16 aa, synthetic construct
CSRDRLIVGASYFDLW

SEQ ID NO: 236 - protein, 20 aa, synthetic construct
CAREKAPAHRSSWSWYFDLW

SEQ ID NO: 237 - protein, 20 aa, synthetic construct
CTREGIAAANPGYFYYMDVW

SEQ ID NO: 238 - protein, 21 aa, synthetic construct
CARCDMVRGVIDHYYNYMDVW

SEQ ID NO: 239 - protein, 20 aa, synthetic construct
CVRQTYDSWTGYSFFYFDYW

SEQ ID NO: 240 - protein, 20 aa, synthetic construct
CTRPMITFGGVIVYDAFDIW

SEQ ID NO: 241 - protein, 16 aa, synthetic construct
CARGWGSSSWYYFDYW

SEQ ID NO: 242 - protein, 16 aa, synthetic construct
CARGIFGVGGNWFDPW

SEQ ID NO: 243 - protein, 14 aa, synthetic construct
CARYSSSWSGFDYW

SEQ ID NO: 244 - protein, 14 aa, synthetic construct
CARGGSYYVYFDYW

SEQ ID NO: 245 - protein, 23 aa, synthetic construct
CSRDTDCSSTSCYFNWNPFFDYW

SEQ ID NO: 246 - protein, 16 aa, synthetic construct
CARGGYSYGLNWFDPW

SEQ ID NO: 247 - protein, 19 aa, synthetic construct
CARTYYDFWSGYLNWFDPW

SEQ ID NO: 248 - protein, 21 aa, synthetic construct
CARWRNYYDSSGSPYWYFDLW

SEQ ID NO: 249 - protein, 19 aa, synthetic construct
CARQGRITMVRGVIPFDYW

SEQ ID NO: 250 - protein, 24 aa, synthetic construct
CAGGYCSSTSCRYNWNYGGWFDPW

SEQ ID NO: 251 - protein, 12 aa, synthetic construct [sequence omitted]

SEQ ID NO: 252 - protein, 16 aa, synthetic construct
CCSYAGRSTLGIDWVF

SEQ ID NO: 253 - protein, 11 aa, synthetic construct [sequence omitted]

SEQ ID NO: 254 - protein, 11 aa, synthetic construct [sequence omitted]

SEQ ID NO: 255 - protein, 13 aa, synthetic construct [sequence omitted]

SEQ ID NO: 256 - protein, 12 aa, synthetic construct [sequence omitted]

SEQ ID NO: 257 - protein, 12 aa, synthetic construct [sequence omitted]

SEQ ID NO: 258 - protein, 12 aa, synthetic construct [sequence omitted]

SEQ ID NO: 259 - protein, 13 aa, synthetic construct [sequence omitted]

SEQ ID NO: 260 - protein, 13 aa, synthetic construct [sequence omitted]

SEQ ID NO: 261 - protein, 13 aa, synthetic construct [sequence omitted]

SEQ ID NO: 262 - protein, 11 aa, synthetic construct [sequence omitted]

SEQ ID NO: 263 - protein, 12 aa, synthetic construct [sequence omitted]

SEQ ID NO: 264 - protein, 14 aa, synthetic construct [sequence omitted]

SEQ ID NO: 265 - protein, 12 aa, synthetic construct [sequence omitted]

SEQ ID NO: 266 - protein, 12 aa, synthetic construct [sequence omitted]

SEQ ID NO: 267 - protein, 12 aa, synthetic construct [sequence omitted]

SEQ ID NO: 268 - protein, 13 aa, synthetic construct [sequence omitted]

SEQ ID NO: 269 - protein, 13 aa, synthetic construct [sequence omitted]

SEQ ID NO: 270 - protein, 11 aa, synthetic construct [sequence omitted]

SEQ ID NO: 271 - protein, 12 aa, synthetic construct [sequence omitted]

SEQ ID NO: 272 - protein, 13 aa, synthetic construct [sequence omitted]

SEQ ID NO: 273 - protein, 13 aa, synthetic construct [sequence omitted]

SEQ ID NO: 274 - protein, 16 aa, synthetic construct
CCSYAGSSTLGIDWVF

SEQ ID NO: 275 - protein, 15 aa, synthetic construct [sequence omitted]

SEQ ID NO: 276 - protein, 15 aa, synthetic construct [sequence omitted]

SEQ ID NO: 277 - protein, 13 aa, synthetic construct [sequence omitted]

SEQ ID NO: 278 - protein, 13 aa, synthetic construct [sequence omitted]

SEQ ID NO: 279 - protein, 13 aa, synthetic construct
CQVWDLYSAHVVF

SEQ ID NO: 280 - protein, 13 aa, synthetic construct [sequence omitted]

SEQ ID NO: 281 - protein, 11 aa, synthetic construct [sequence omitted]

SEQ ID NO: 282 - protein, 12 aa, synthetic construct
CSAYAGSNNVVF

SEQ ID NO: 283 - protein, 13 aa, synthetic construct [sequence omitted]

SEQ ID NO: 284 - protein, 12 aa, synthetic construct
CQSADSSATWVF

SEQ ID NO: 285 - protein, 13 aa, synthetic construct [sequence omitted]

SEQ ID NO: 286 - protein, 13 aa, synthetic construct
CQSLDSSGTYWVF

SEQ ID NO: 287 - protein, 11 aa, synthetic construct [sequence omitted]

SEQ ID NO: 288 - protein, 11 aa, synthetic construct [sequence omitted]

SEQ ID NO: 289 - protein, 11 aa, synthetic construct [sequence omitted]

SEQ ID NO: 290 - protein, 13 aa, synthetic construct [sequence omitted]

SEQ ID NO: 291 - protein, 10 aa, synthetic construct [sequence omitted]

SEQ ID NO: 292 - protein, 13 aa, synthetic construct [sequence omitted]

SEQ ID NO: 293 - protein, 13 aa, synthetic construct [sequence omitted]

SEQ ID NO: 294 - protein, 13 aa, synthetic construct [sequence omitted]

SEQ ID NO: 295 - protein, 12 aa, synthetic construct [sequence omitted]

SEQ ID NO: 296 - protein, 9 aa, synthetic construct [sequence omitted]

SEQ ID NO: 297 - protein, 11 aa, synthetic construct [sequence omitted]

SEQ ID NO: 298 - protein, 11 aa, synthetic construct [sequence omitted]

SEQ ID NO: 299 - protein, 11 aa, synthetic construct [sequence omitted]

SEQ ID NO: 300 - protein, 11 aa, synthetic construct [sequence omitted]

SEQ ID NO: 301 - protein, 13 aa, synthetic construct [sequence omitted]

SEQ ID NO: 302 - protein, 13 aa, synthetic construct [sequence omitted]

SEQ ID NO: 303 - protein, 13 aa, synthetic construct [sequence omitted]

SEQ ID NO: 304 - protein, 13 aa, synthetic construct [sequence omitted]

SEQ ID NO: 305 - protein, 11 aa, synthetic construct [sequence omitted]

SEQ ID NO: 306 - protein, 12 aa, synthetic construct [sequence omitted]

SEQ ID NO: 307 - protein, 12 aa, synthetic construct [sequence omitted]

SEQ ID NO: 308 - protein, 13 aa, synthetic construct [sequence omitted]

SEQ ID NO: 309 - protein, 11 aa, synthetic construct [sequence omitted]

SEQ ID NO: 310 - protein, 12 aa, synthetic construct [sequence omitted]

SEQ ID NO: 311 - protein, 12 aa, synthetic construct [sequence omitted]

SEQ ID NO: 312 - protein, 13 aa, synthetic construct [sequence omitted]

SEQ ID NO: 313 - protein, 13 aa, synthetic construct [sequence omitted]

SEQ ID NO: 314 - protein, 13 aa, synthetic construct [sequence omitted]

SEQ ID NO: 315 - protein, 13 aa, synthetic construct [sequence omitted]

SEQ ID NO: 316 - protein, 13 aa, synthetic construct [sequence omitted]

SEQ ID NO: 317 - protein, 13 aa, synthetic construct [sequence omitted]

SEQ ID NO: 318 - protein, 12 aa, synthetic construct [sequence omitted]

SEQ ID NO: 319 - protein, 12 aa, synthetic construct [sequence omitted]

SEQ ID NO: 320 - protein, 12 aa, synthetic construct [sequence omitted]

SEQ ID NO: 321 - protein, 12 aa, synthetic construct [sequence omitted]

SEQ ID NO: 322 - protein, 13 aa, synthetic construct [sequence omitted]

SEQ ID NO: 323 - protein, 13 aa, synthetic construct [sequence omitted]

SEQ ID NO: 324 - protein, 13 aa, synthetic construct [sequence omitted]

SEQ ID NO: 325 - protein, 11 aa, synthetic construct [sequence omitted]

SEQ ID NO: 326 - protein, 11 aa, synthetic construct [sequence omitted]

SEQ ID NO: 327 - protein, 12 aa, synthetic construct
CQVWDSSGSWVF

SEQ ID NO: 328 - protein, 13 aa, synthetic construct [sequence omitted]

SEQ ID NO: 329 - protein, 13 aa, synthetic construct
CNSRDTSGNYLVF

SEQ ID NO: 330 - protein, 13 aa, synthetic construct [sequence omitted]

SEQ ID NO: 331 - protein, 13 aa, synthetic construct [sequence omitted]

SEQ ID NO: 332 - protein, 13 aa, synthetic construct [sequence omitted]

SEQ ID NO: 333 - protein, 13 aa, synthetic construct [sequence omitted]

SEQ ID NO: 334 - protein, 11 aa, synthetic construct [sequence omitted]

SEQ ID NO: 335 - protein, 12 aa, synthetic construct [sequence omitted]

SEQ ID NO: 336 - protein, 13 aa, synthetic construct [sequence omitted]

SEQ ID NO: 337 - protein, 12 aa, synthetic construct [sequence omitted]

SEQ ID NO: 338 - protein, 12 aa, synthetic construct [sequence omitted]

SEQ ID NO: 339 - protein, 12 aa, synthetic construct [sequence omitted]

SEQ ID NO: 340 - protein, 13 aa, synthetic construct [sequence omitted]

SEQ ID NO: 341 - protein, 11 aa, synthetic construct [sequence omitted]

SEQ ID NO: 342 - protein, 11 aa, synthetic construct [sequence omitted]

SEQ ID NO: 343 - protein, 11 aa, synthetic construct
CQSANSGTWVF

SEQ ID NO: 344 - protein, 11 aa, synthetic construct [sequence omitted]

SEQ ID NO: 345 - protein, 12 aa, synthetic construct [sequence omitted]

SEQ ID NO: 346 - protein, 13 aa, synthetic construct [sequence omitted]

SEQ ID NO: 347 - protein, 13 aa, synthetic construct [sequence omitted]

SEQ ID NO: 348 - protein, 13 aa, synthetic construct [sequence omitted]

SEQ ID NO: 349 - protein, 13 aa, synthetic construct [sequence omitted]

SEQ ID NO: 350 - protein, 13 aa, synthetic construct [sequence omitted]

SEQ ID NO: 351 - protein, 13 aa, synthetic construct [sequence omitted]

SEQ ID NO: 352 - protein, 13 aa, synthetic construct [sequence omitted]

SEQ ID NO: 353 - protein, 13 aa, synthetic construct [sequence omitted]

SEQ ID NO: 354 - protein, 13 aa, synthetic construct [sequence omitted]

SEQ ID NO: 355 - protein, 11 aa, synthetic construct [sequence omitted]

SEQ ID NO: 356 - protein, 12 aa, synthetic construct [sequence omitted]

SEQ ID NO: 357 - protein, 12 aa, synthetic construct [sequence omitted]

SEQ ID NO: 358 - protein, 12 aa, synthetic construct [sequence omitted]

SEQ ID NO: 359 - protein, 12 aa, synthetic construct [sequence omitted]

SEQ ID NO: 360 - protein, 13 aa, synthetic construct [sequence omitted]

SEQ ID NO: 361 - protein, 13 aa, synthetic construct [sequence omitted]

SEQ ID NO: 362 - protein, 7 aa, synthetic construct
CQATEVF

SEQ ID NO: 363 - protein, 10 aa, synthetic construct [sequence omitted]

SEQ ID NO: 364 - protein, 11 aa, synthetic construct [sequence omitted]

SEQ ID NO: 365 - protein, 11 aa, synthetic construct [sequence omitted]

SEQ ID NO: 366 - protein, 12 aa, synthetic construct [sequence omitted]

SEQ ID NO: 367 - protein, 13 aa, synthetic construct [sequence omitted]

SEQ ID NO: 368 - protein, 10 aa, synthetic construct
CCSYAQGVVF

SEQ ID NO: 369 - protein, 13 aa, synthetic construct [sequence omitted]

SEQ ID NO: 370 - protein, 13 aa, synthetic construct [sequence omitted]

SEQ ID NO: 371 - protein, 13 aa, synthetic construct [sequence omitted]

SEQ ID NO: 372 - protein, 13 aa, synthetic construct [sequence omitted]

SEQ ID NO: 373 - protein, 13 aa, synthetic construct [sequence omitted]

SEQ ID NO: 374 - protein, 13 aa, synthetic construct [sequence omitted]

SEQ ID NO: 375 - protein, 13 aa, synthetic construct [sequence omitted]

SEQ ID NO: 376 - protein, 13 aa, synthetic construct [sequence omitted]

SEQ ID NO: 377 - protein, 13 aa, synthetic construct [sequence omitted]

SEQ ID NO: 378 - protein, 13 aa, synthetic construct [sequence omitted]

SEQ ID NO: 379 - protein, 13 aa, synthetic construct [sequence omitted]

SEQ ID NO: 380 - protein, 13 aa, synthetic construct [sequence omitted]

SEQ ID NO: 381 - protein, 11 aa, synthetic construct [sequence omitted]

SEQ ID NO: 382 - protein, 12 aa, synthetic construct [sequence omitted]

SEQ ID NO: 383 - protein, 13 aa, synthetic construct [sequence omitted]

SEQ ID NO: 384 - protein, 13 aa, synthetic construct [sequence omitted]

SEQ ID NO: 385 - protein, 14 aa, synthetic construct [sequence omitted]

SEQ ID NO: 386 - protein, 11 aa, synthetic construct
CMIWHSSAIVF

SEQ ID NO: 387 - protein, 11 aa, synthetic construct [sequence omitted]

SEQ ID NO: 388 - protein, 11 aa, synthetic construct [sequence omitted]

SEQ ID NO: 389 - protein, 13 aa, synthetic construct [sequence omitted]

SEQ ID NO: 390 - protein, 13 aa, synthetic construct [sequence omitted]

SEQ ID NO: 391 - protein, 13 aa, synthetic construct [sequence omitted]

SEQ ID NO: 392 - protein, 13 aa, synthetic construct [sequence omitted]

SEQ ID NO: 393 - protein, 13 aa, synthetic construct [sequence omitted]

SEQ ID NO: 394 - protein, 13 aa, synthetic construct [sequence omitted]

SEQ ID NO: 395 - protein, 13 aa, synthetic construct [sequence omitted]

SEQ ID NO: 396 - protein, 12 aa, synthetic construct [sequence omitted]

SEQ ID NO: 397 - protein, 12 aa, synthetic construct [sequence omitted]

SEQ ID NO: 398 - protein, 12 aa, synthetic construct [sequence omitted]

SEQ ID NO: 399 - protein, 13 aa, synthetic construct [sequence omitted]

SEQ ID NO: 400 - protein, 11 aa, synthetic construct [sequence omitted]

SEQ ID NO: 401 - protein, 13 aa, synthetic construct [sequence omitted]

SEQ ID NO: 402 - protein, 13 aa, synthetic construct [sequence omitted]

SEQ ID NO: 403 - protein, 12 aa, synthetic construct
CCSYAGTISWVF

SEQ ID NO: 404 - protein, 12 aa, synthetic construct [sequence omitted]

SEQ ID NO: 405 - protein, 12 aa, synthetic construct [sequence omitted]

SEQ ID NO: 406 - protein, 12 aa, synthetic construct [sequence omitted]

SEQ ID NO: 407 - protein, 13 aa, synthetic construct [sequence omitted]

SEQ ID NO: 408 - protein, 13 aa, synthetic construct [sequence omitted]

SEQ ID NO: 409 - protein, 14 aa, synthetic construct [sequence omitted]

SEQ ID NO: 410 - protein, 11 aa, synthetic construct [sequence omitted]

SEQ ID NO: 411 - protein, 11 aa, synthetic construct
CYSTDSSGKIF

SEQ ID NO: 412 - protein, 13 aa, synthetic construct [sequence omitted]

SEQ ID NO: 413 - protein, 13 aa, synthetic construct [sequence omitted]

SEQ ID NO: 414 - protein, 13 aa, synthetic construct [sequence omitted]

SEQ ID NO: 415 - protein, 13 aa, synthetic construct [sequence omitted]

SEQ ID NO: 416 - protein, 13 aa, synthetic construct [sequence omitted]

SEQ ID NO: 417 - protein, 13 aa, synthetic construct [sequence omitted]

SEQ ID NO: 418 - protein, 12 aa, synthetic construct [sequence omitted]

SEQ ID NO: 419 - protein, 12 aa, synthetic construct [sequence omitted]

SEQ ID NO: 420 - protein, 13 aa, synthetic construct [sequence omitted]

SEQ ID NO: 421 - protein, 13 aa, synthetic construct [sequence omitted]

SEQ ID NO: 422 - protein, 13 aa, synthetic construct [sequence omitted]

SEQ ID NO: 423 - protein, 13 aa, synthetic construct [sequence omitted]

SEQ ID NO: 424 - protein, 11 aa, synthetic construct [sequence omitted]

SEQ ID NO: 425 - protein, 13 aa, synthetic construct
CQSYDGTLGGWIF

SEQ ID NO: 426 - protein, 13 aa, synthetic construct [sequence omitted]

SEQ ID NO: 427 - protein, 11 aa, synthetic construct [sequence omitted]

SEQ ID NO: 428 - protein, 11 aa, synthetic construct [sequence omitted]

SEQ ID NO: 429 - protein, 13 aa, synthetic construct [sequence omitted]

SEQ ID NO: 430 - protein, 13 aa, synthetic construct [sequence omitted]

SEQ ID NO: 431 - protein, 10 aa, synthetic construct
CSSYAGSNNF

SEQ ID NO: 432 - protein, 13 aa, synthetic construct [sequence omitted]

SEQ ID NO: 433 - protein, 13 aa, synthetic construct [sequence omitted]

SEQ ID NO: 434 - protein, 11 aa, synthetic construct [sequence omitted]

SEQ ID NO: 435 - protein, 13 aa, synthetic construct [sequence omitted]

SEQ ID NO: 436 - protein, 12 aa, synthetic construct [sequence omitted]

SEQ ID NO: 437 - protein, 12 aa, synthetic construct [sequence omitted]

SEQ ID NO: 438 - protein, 11 aa, synthetic construct [sequence omitted]

SEQ ID NO: 439 - protein, 122 aa, synthetic construct
QVQLQQSGPGLVKPSQTLSLTCAISGDSVSSNSAAWNWIRQSPSRGLEWLGRTYYRSKWYNDYAVSVKSRITINPDTSKNQFSLQLNSVTPEDTAVYYCARKGELLGAFDIWGQGTMVTVSS

SEQ ID NO: 440 - protein, 122 aa, synthetic construct
QVQLQQSGPGLVKPSQTLSLTCAISGDSVSSNSAAWNWIRQSPSRGLEWLGRTYYRSKWYNDYAGSVKSRIIIIPDTSKNQLSLQLKSVTPEDTAVYYCARKWELRDAFDIWGQGTMVTVSS

SEQ ID NO: 441 - protein, 120 aa, synthetic construct
EVQLVESGGSVVRPGGSLRLSCAASGFTFDDYGMSWVRQAPGKGLEWVSGINWNGGSTGYADSVKGRFTISRDNAKNSLYLQMNSLRAEDTALYYCAREDYGDPGWFDPWGQGTLVTVSS

SEQ ID NO: 442 - protein, 117 aa, synthetic construct
QLQLQESGPGLVKPSETLSLTCTVSGGSISSSSYYWGWIRQPPGKGLEWIGSIYYSGSTYYNPSLKSRVTISVDTSKNQFSLKLSSVTAADTAVYYCATLTGDGDYWGQGTLVTVSS

SEQ ID NO: 443 - protein, 120 aa, synthetic construct
EVQLVESGGGLVKPGGSLRLSCAASGFTFSSYSMNWVRQAPGKGLEWVSSISSSSSYIYYADSVKGRFTISRDNAKNSLYLQMNSLRAEDTAVYYCARDRSSSWYSFDYWGQGTLVTVSS

SEQ ID NO: 444 - protein, 121 aa, synthetic construct
EVQLVESGGGLVTPGGSLRLSCAASGFTFNNYSMNWVRQAPGKGLEWVSSISSSSSYIYYADSVKGRFTISRDNAKNSLYLPMISLRAEDTAVYYCARDGITGTTFYFDYWGQGTLVTVSS

SEQ ID NO: 445 - protein, 117 aa, synthetic construct
QVQLVESGGGVVQPGRSLRLSCAASGFTFSSYGMHWVRQAPGKGLEWVAVIWYDGSNKYYADSVKGRFTISRDNSKNTLYLQMNSLRAEDTAVYYCASIAAAGRDYWGQGTLVTVSS

SEQ ID NO: 446 - protein, 117 aa, synthetic construct
EVQLVESGGGLVQPGGSLRLSCAASGFTFSSYAMSWVRQAPGKGLEWVSAISGSGGSTYYADSVKGRFTISRDNSKNTLYLQMNSLRAEDTAVYYCAKAPELRFDYWGQGTLVTVSS

SEQ ID NO: 447 - protein, 117 aa, synthetic construct
QVQLVQSGAEVKKPGASVKVSCKASGYTFTSYGISWVRQAPGQGLEWMGWISPYNGNTNYAQNLQDRVTMITDTSTTTAYMELRSLRSDDTAVYYCARNHYYYMDVWGKGTTVTVSS

SEQ ID NO: 448 - protein, 120 aa, synthetic construct
QVQLQQWGAGLLKPSETLSLTCAVYGGSFSGYYWSWIRQPPGKGLEWIGEINHSGSTNYNPSLKSRVTISVDTSKNQFSLKLSSVTAADTAVYYCARGELGIGYWYFDLWGRGTLVTVSS

SEQ ID NO: 449 - protein, 122 aa, synthetic construct
QVQLVESGGGVVQPGRSLRLSCAASGFTFSSYGMHWVRQAPGKGLEWVAVIWYDGSNKYYADSVKGRFTISRDNSKNTLYLQMNSLRAEDTAVYYCARDTGITMVRGVFDYWGQGTLVTVSS

SEQ ID NO: 450 - protein, 122 aa, synthetic construct
EVQLVESGGDLVQPGGSLKLSCAASGFSFSGSTLHWVRQASGKGLEWIGHIRSKPNNYATLYGASVKGRFTISRDDSKNTAYLQMNSLKIEDTAVYYCNGVYGGSSYFFDYWGQGTLVTVSS

SEQ ID NO: 451 - protein, 117 aa, synthetic construct
QVQLVQSGAEVKKPGASVKVSCKASGYTFTGYYMHWVRQAPGQGLEWMGWINPNSGGTNYAQKFQGRVTMTRDTSISTAYMELSRLRSDDTAVYYCARDETTIFDYWGQGTLVTVSS

SEQ ID NO: 452 - protein, 129 aa, synthetic construct
QVQLVQSGAEVTKPGASVKVSCKASGYTFINYGISWVRQAPGQGLEWMGWISAYSGNRNYAQKFQDRVIMTTDTFTNTAYMELRSLRSDDTAVYYCARLGCNGTSCYTSWYYHFYMDVWGKGTTVTVSS

SEQ ID NO: 453 - protein, 123 aa, synthetic construct
QVQLVESGGGVVQPGRSLRLSCAASGFTFSSYGMHWVRQAPGKGLEWVAVIWYDGSNKYYADSVKGRFTISRDNSKNTLYLQMNSLRAEDTAVYYCARDEDYYGSGSYSFDYWGQGTLVTVSS

SEQ ID NO: 454 - protein, 118 aa, synthetic construct
QVQLQESGPGLVKPSGTLSLTCAVSGGSISSSNWWSWVRQPPGKGLEWIGEIYHSGSTNYNPSLKSRVTISVDKSKNQFSLKLSSVTAADTAVYYCARRGAARPFDYWGQGTLVTVSS

SEQ ID NO: 455 - protein, 120 aa, synthetic construct
QITLKESGPTLVKPTQTLTLTCTFSGFSLSTSGVGVGWIRQPPGKALEWLALIYWNDDKRYSPSLKSRLTITKDTSKNQVVLTMTNMDPVDTATYYCAHSNWNYGYFDLWGRGTLVTVSS

SEQ ID NO: 456 - protein, 119 aa, synthetic construct
EVQLVESGGGLVQPGGSLRLSCAASGFTFSSYAMSWVRQAPGKGLEWVSAISGSGGSTYYADSVKGRFTISRDNSKNTLYLQMNSLRAEDTAVYYCAKKDIVATHFDYWGQGTLVTVSS

SEQ ID NO: 457 - protein, 124 aa, synthetic construct
EVQLVESGGGLVKPGGSLRLSCAASGFTFSNAWMSWVRQAPGKGLEWVGRIKSKTDGGTTDYAAPVKGRFTISRDDSKNTLYLQMNSLKTEDTAVYYCTTADYDFWSGYYMDVWGKGTTVTVSS

SEQ ID NO: 458 - protein, 116 aa, synthetic construct
EVQLVESGGGLVQPGGSLRLSCAASGFTFSSYSMNWVRQAPGKGLEWVSYISSSSSTIYYADSVKGRFTISRDNAKNSLYLQMNSLRDEDTAVYYCARDRYNFDYWGQGTLVTVSS

SEQ ID NO: 459 - protein, 121 aa, synthetic construct
EVQLVESGGGVVRPGGSLRLSCAASGFTFDDYGMSWVRQAPGKGLEWVSGINWNGGSTGYADSVKGRFTISRDNAKNSLYLQMNSLRAEDTALYYCARGGDTAMVTVFDYWGQGTLVTVSS

SEQ ID NO: 460 - protein, 118 aa, synthetic construct
EVQLVQSGAEVKKPGESLKISCKGSGYSFTSYWIGWVRQMSGKGLEWMGIIYPSDSDTRYSPSFQGQVTISADKSISTAYLQWSSLKASDTAMYYCARQINWGAIDYWGQGTLVTVSS

SEQ ID NO: 461 - protein, 119 aa, synthetic construct
QVQLVQSGAEVKKPGASVKVSCKASGYTFTSYGISWVRQAPGQGLEWMGWISVYNGNTNYAQKLQGRVTMTTDTSTSTAYMELRSLRSDDTAVYYCARQITATRGFDYWGQGTLVTVSS

SEQ ID NO: 462 - protein, 122 aa, synthetic construct
QVQLQQSGPGLVKPSQTLSLTCAISGDSVSSNSAAWSWIRQSPSRGLEWLGRTYYRSKWYNDYAVSVKSRITINPDTSKNQFSLQLNSVTPEDTAVYYCARKWELRDTFDIWGQGTMVTVSS

SEQ ID NO: 463 - protein, 115 aa, synthetic construct
QVQLQQWGAGLLKPSETLSLTCAVYGGSFSGYYWSWIRQPPGKGLEWIGEINHSGSTNYNPSLKSRVTISVDTSKNQFSLKLSSVTAADTAVYYCASYGDFFDYWGQGTLVTVSS

SEQ ID NO: 464 - protein, 118 aa, synthetic construct
EVQLVESGGGLVKPGGSLRLSCAASGFTFSSYSMNWVRQAPGKGLEWVSSISSSSSYIYYADSVKGRFTISRDNAKNSLYLQMNSLRAEDTAVYYCARETELTVMDVWGKGTTVTVSS

SEQ ID NO: 465 - protein, 129 aa, synthetic construct
EVQLVESGGGLVKPGGSLRLSCAASGFTFSNAWMSWVRQAPGKGLEWVGRIKSKTDGGTTDYAAPVKGRFTISRDDSKNTLYLQMNSLKTEDTAVYYCTTDWEYYDFWSGYYSPYFDYWGQGTLVTVSS

SEQ ID NO: 466 - protein, 114 aa, synthetic construct
QVQLQESGPGLVKPSQTLSLTCTVSGGSISSGGYYWSWIRQHPGKGLEWIGYIYYIGITYYNPSLKSRVTISVDTSKNQFSLKLSSVTAADTAVYYCARAFDYWGQGTLVTVSS

SEQ ID NO: 467 - protein, 114 aa, synthetic construct
QVQLQESGPGLVKPSQTLSLTCTVSGGSISSGGYYWSWIRQHPGKGLEWIGYFYYSGSTYYNPSLKSRVSISVDTSKNQFSLRLSSVTVADTAVYYCVRAFDYWGQGTLVTASS

SEQ ID NO: 468 - protein, 114 aa, synthetic construct
EVQLVESGGGLVKPGGSLRLSCAASGFTFSNAWMSWVRQAPGKGLEWVGRIKSKTDGGTTDYAAPVKGRFTISRDDSKNTLYLQMNSLKTEDTAVYYCTTGANWGQGTLVTVSS

SEQ ID NO: 469 - protein, 114 aa, synthetic construct
QVQLVQSGAEVKKPGASVKVSCKASGYTFTSYDINWVRQATGQGLEWMGWMNPNSGNTGYAQKFQGRVTMTRNTSISTAYMELSSLRSEDTAVYYCARVAFDIWGQGTMVTVSS

SEQ ID NO: 470 - protein, 114 aa, synthetic construct
QVQLVQSGAEAKKPGASVKVSCMASGYTFTTYGISWVRQAPGQGLEWMGWISAYNGNTKYAQKLQGRVTMTTDTSTRTAYMELRSLRSDDTAVYYCARQIGDYWGQGTLVTVSS

SEQ ID NO: 471 - protein, 114 aa, synthetic construct
EVQLVESGGGLVQPGGSLRLSCAASGFTFSSYAMSWVRQAPGKGLEWVSAISGSGGSTYYADSVKGRFTISRDNSKNTLYLQMNSLRAEDTAVYYCHQTGEDYWGQGTLVTVSS

SEQ ID NO: 472 - protein, 115 aa, synthetic construct
EVQLVESGGGLVKPGGSLRLSCAASGFTFSNAWMSWVRQAPGKGLEWVGRIKSKSDGGTRDYAAPVKGRFTISRDDSKNTLYLQMNSLKTEDTAMFYCTTGGTHWGQGTLVTVSS

SEQ ID NO: 473 - protein, 115 aa, synthetic construct
QVQLVQSGAEVKKPGASVKVSCKASGYTFTSYDINWVRQATGQGLEWMGWMNPNSGNTGYAQKFQGRVTMTRNTSISTAYMELSSLRSEDTAVYYCARRSFLDYWGQGTLVTVSS

SEQ ID NO: 474 - protein, 115 aa, synthetic construct
EVQLVESGGGLVKPGGSLRLSCAASGFTFSNAWMSWVRQAPGKGLEWVGRIKSKTDGGTTDYATPVKGRFTISRADSKNTLFLQMSSLKTEDTAVYFCTTGGTNWGQGTLVTVSS

SEQ ID NO: 475 - protein, 116 aa, synthetic construct
EVQLVESGGGLVKPGGSLRLSCAASGFTFSSYSMNWVRQAPGKGLEWVSSISSSSSYIYYADSVKGRFTISRDNAKNSLYLQMNSLRAEDTAVYYCARESSGFDYWGQGTLVTVSS

SEQ ID NO: 476 - protein, 116 aa, synthetic construct
QVQLVQSGAEVKKPGASVKVSCKASGYTFTSYDINWVRQATGQGLEWMGWMNPNSGNTGYAQKFQGRVTMTRNTSISTAYMELSSLRSEDTAVYYCARGSSWFDYWGQGTLVTVSS

SEQ ID NO: 477 - protein, 116 aa, synthetic construct
EVQLVESGGGLVKPGGSLRLSCAASGFTFSNAWMSWVRQAPGKGLEWVGRIKSKTDGGTTDYAAPVKGRFTISRDDSKNTLYLQMNSLKTEDTAVYYCTLNWGDYWGQGTLVTVSS

SEQ ID NO: 478 - protein, 116 aa, synthetic construct
EVQLVESGGGLVKPGGSLRLSCAASGFTFSSYSMNWVRQAPGKGLEWVSSISSSSSYIYYADSVKGRFTISRDNAKNSLYLQMNSLRAEDTAVYYCARAADAFDIWGQGTMVTVSS

SEQ ID NO: 479 - protein, 116 aa, synthetic construct
EVQLVESGGGLVQPGGSLRLSCAASGFTFSSYDMHWVRQATGKGLEWVSAIGTAGDTYYPGSVKGRFTISRENAKNSLYLQMNSLRAGDTAVYYCARGGSDAFDIWGQGTMVTVSS

SEQ ID NO: 480 - protein, 116 aa, synthetic construct
EVQLVESGGGLVKPGGSLRLSCTASEFTFRNAWMIWVRQAPGKGLEWVGRIRSEIDGGTTDYAAPVKGRFTISRDDSKDTLYLYMNSLKVEDTAVYYCTTDHPYYWGHGTLVTVSS

SEQ ID NO: 481 - protein, 116 aa, synthetic construct
EVQLVESGGGLVKPGGSLRLSCAASGFTFSNAWMSWVRQAPGKGLEWVGRIKSKTDGGTTDFTAPVKGRFTISRDDSKNTLYLQMNSLKTEDTAVYYCTTDHPYYWGQGTLVTVSS

SEQ ID NO: 482 - protein, 116 aa, synthetic construct
QVQLVESGGGVVQPGRSLRLSCAASGFTFSNYGIHWVRQAPGKGLEWVAVIWYDGSNEYYVDSVKGRFIISRDNSKNTLYLQMNSLRAEDTALYYCALAVTGFDYWGQGTLVTVSS

SEQ ID NO: 483 - protein, 116 aa, synthetic construct
QVQLVESGGGLVKPGGSLRLSCAASGFTFSDYYMSWIRQAPGKGLEWVSYISSSGSTIYYPDSVKGRFTISRDNAKNSLYLQMNSLRAEDTAVYYCARDGAAFDIWGQGTMVTVSS

SEQ ID NO: 484 - protein, 117 aa, synthetic construct
QIQLVQSGAEMKKPGASVKVSCKASGYTFTNYGISWVRQAPGQGLEWMGWINTYNDKTNFALKVQGRVTMTTDTSTSTAYMELRSLRSDDTAVYYCARDRGYSFDYWGQGTLVTVSS

SEQ ID NO: 485 - protein, 117 aa, synthetic construct
QVQLVQSGAEVKKPGASVKVSCKASGYTFTSYGISWVRQAPGQGLEWMGWISAYNGNTNYAQRLQGRVTMTTDTSTSTAYMELRSLISDDTAVYYCARNHYYYLDVWGKGTTVTVSS

SEQ ID NO: 486 - protein, 117 aa, synthetic construct
EVQLVESGGGLVQPGGSLRLSCAASGFTFSSYDMHWVRQATGKGLEWVSAIGTAGDTYYPGSVKGRFTISRENAKNSLYLQMNSLRAGDTAVYYCARVSPTGTTDYWGQGTLVTVSS

SEQ ID NO: 487 - protein, 117 aa, synthetic construct
EVQLVESGGGLVKPGGSLRLSCAASGFTFSNAWMSWVRQAPGKGLEWVGRIKSKTDGGTTDYAAPVKGRFTISRDDSKNTLYLQMNSLKTEDTAVYYCTARPLGDVWGKGTTVTVSS

SEQ ID NO: 488 - protein, 117 aa, synthetic construct
EVQLVESGGGLVKPGGSLRLSCAASGFTFSNAWMSWVRQAPGKGLEWVGRIKSKTDGGTTDYAAPVKGRFTISRDDSKNTLYLQMNSLKTEDTAVYYCTTDNGFDYWGQGTLVTVSS

SEQ ID NO: 489 - protein, 117 aa, synthetic construct
EVQLVESGGGLVKPGGSLRLSCAASGFTFSSYSMNWVRQAPGKGLEWVSSISSSSSYIYYADSVKGRFTISRDNAKNSLYLQMNSLRAEDTAVYYCARDLISSFDYWGQGTLVTVSS

SEQ ID NO: 490 - protein, 117 aa, synthetic construct
EVQLVESGGGLVQPGGSLRLSCAASGFTFSSYWMSWVRQAPGKGLEWVANIKQDGSEKYYVDSVKGRFTISRDNAKNSLYLQMNSLRAEDTAVYYCARRIVGAFDYWGQGTLVTVSS

SEQ ID NO: 491 - protein, 117 aa, synthetic construct
QVQLIQSGTEVKKPGASVKVSCMASRYTFTSYYIHWVRQAPGQGLEWMGIINPSGGTTGYAQKFQGRVTMTRDTSTSTVYMELYSLRSEDTAVYYCARGGWGTMDVWGKGTTVTVSS

SEQ ID NO: 492 - protein, 117 aa, synthetic construct
EVQLVESGGGLVQPGGSLRLSCAASGFTFSSYSMNWVRQAPGKGLEWVSYISSSSSTIYYADSVKGRFTISRDNAKNSLYLQMNSLRDEDTAVYYCAREGWELLDYWGQGTLVTVSS

SEQ ID NO: 493 - protein, 117 aa, synthetic construct
EVQLVESGGGLIQPGGSLRLSCAASGLTVSTNYMSWVRQAPGKGLEWVSVLYSGGGTYYADSVKGRFTISRDNSKNTLCLQMNSLRAEDTAMYYCARDNWDSYFDYWGQGTLVTVSS

SEQ ID NO: 494 - protein, 117 aa, synthetic construct
EVQLVESGGGVVRPGGSLRLSCAASGFTFDDYGMSWVRQAPGKGLEWVSGINWNGGSTGYADSVKGRFTISRDNAKNSLYLQMNSLRAEDTALYYCARTTVTHMDVWGKGTTVTVSS

SEQ ID NO: 495 - protein, 117 aa, synthetic construct
EVQLVESGGGLIQPGGSLRLSCAASGFTVSSNYMSWVRQAPGKGLEWVSVIYSGGSTYYADSVKGRFTISRDNSKNTLYLQMNSLRAEDTAVYYCARDWNYDAFDIWGQGTMVTVSS

SEQ ID NO: 496 - protein, 117 aa, synthetic construct
EVQLVESGGGLVKPGGSLRLSCAASGFTFSSYSMNWVRQAPGKGLEWVSSISSSSSYIYYADSVKGRFTISRDNAKNSLYLQMNSLRAEDTAVYYCARGDPGWFDPWGQGTLVTVSS

SEQ ID NO: 497 - protein, 118 aa, synthetic construct
EVQLVESGGGLVQPGGSLRLSCAASGFTFSSYWMHWVRQAPGKGLVWVSRINSDGSSTSYADSVKGRFTISRDNAKNTLYLQMNSLRAEDTAVYYCARENWNYWFDPWGQGTLVTVSS

SEQ ID NO: 498 - protein, 118 aa, synthetic construct
QVQLQESGPGLVKPSGTLSLTCAVSGGSISSNNWWSWVRQPPGKGLEWIGEIYHSGSTNYNPSLKSRVTISVDKSKNQFSLKVNSVTAADTAIFYCARLRPGDSFDYWGLGTLVTVSS

SEQ ID NO: 499 - protein, 118 aa, synthetic construct
QVHLVQSGSELKKPGASVKVSCKASGYTFTRNGLNWVRQAPGQGLEWMGWINTNIGNPTYAQGFTGRFVFSLDTSVSTAYLQISRLQAEDTAVYYCARSPNWGLFDYWGQGTLVTVSS

SEQ ID NO: 500 - protein, 118 aa, synthetic construct
EVQLVESGGGLVKPGGSLRLSCAASGFTFSSYSMNWVRQAPGKGLEWVSSISSSSSYIYYADSVKGRFTISRDNAKNSLYLQMNSLRAEDTAVYYCARDRGATGFDYWGQGTLVTVSS

SEQ ID NO: 501 - protein, 118 aa, synthetic construct
QVQLVQSGAEVKKPGASVKVSCKASGYTFTSYGISWVRQAPGQGLEWMGWISAYNGNTNYAQKLQGRVTMTTDTSTSTAYMELRSLRSDDTAVYYCARESGELLGDYWGQGTLVTVSS

SEQ ID NO: 502 - protein, 118 aa, synthetic construct
EVQLVESGGGLVQPGGSLRLSCAASGFTFSSYDMHWVRQATGKGLEWVSAIGTAGDTYYPGSVKGRFTISRENAKNSLYLQMNSLRAGDTAVYYCARYSGSYYYFDYWGQGTLVTVSS

SEQ ID NO: 503 - protein, 118 aa, synthetic construct
QVQLVESGGGVVQPGRSLRLSCAASGFTFSSYGMHWVRQAPGKGLEWVAVIWYDGSNKYYADSVKGRFTISRDNSKNTLYLQMNSLRAEDTAVYYCARGIAAAGKDYWGQGTLVTVSS

SEQ ID NO: 504 - protein, 118 aa, synthetic construct
EVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARQDSNYVFDYWGQGTLVTVSS

SEQ ID NO: 505 - protein, 118 aa, synthetic construct
EVQLVESGGGLVQPGGSLRLSCAASGFTFSNYWMSWVRQAPGKGLEWVANIKYDGREQYYVDSVKGRFAISRDNAKNSLSLQMNSLRAEDTAIYYCARDHSAWSFDYWGQGTLVTVSS

SEQ ID NO: 506 - protein, 118 aa, synthetic construct
EVQLVESGGGLVQPGGSLRLSCAASGFTFSSYWMSWVRQAPGKGLEWVANIKQDGSEKYYVDSVKGRFTISRDNAKNSLYLQMNSLRAEDTAVYYCARRRGSCSFDYWGQGTLVTVSS

SEQ ID NO: 507 - protein, 118 aa, synthetic construct
QVQLVQSGAEVKKPGASVKVSCKASGYTFTSYGISWVRQAPGQGLEWMGWISAYNGNTNYAQKLQGRVTMTTDTSTSTAYMELRSLRSDDTAVYYCARRSYANCFDYWGQGTLVTVSS

SEQ ID NO: 508 - protein, 118 aa, synthetic construct
EVQLVESGGGLVQPGGSLRLSCAASGFTFSSYWMHWVRQAPGKGLVWVSRINSDGSSTSYADSVKGRFTISRDNAKNTLYLQMNSLRAEDTAVYYCARDEQLVPFDIWGQGTMVTVSS

SEQ ID NO: 509 - protein, 118 aa, synthetic construct
EVQLVESGGGLIQPGGSLRLSCAASGFTVSSNYMSWVRQAPGKGLEWVSVIYSGGSTYYADSVKGRFTISRDNSKNTLYLQMNSLRAEDTAVYYCARDGAAAGDFQHWGQGTLVTVSS

SEQ ID NO: 510 - protein, 118 aa, synthetic construct
EVQLVESGGGLVQPGRSLRLSCAASGFTFDDYAMHWVRQAPGKGLEWVSGISWNSGSIGYADSVKGRFTISRDNAKNSLYLQMNSLRAEDTALYYCAKDSGSYYFDYWGQGTLVTVSS

SEQ ID NO: 511 - protein, 118 aa, synthetic construct
QVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARDGQLWSFDYWGQGTLVTVSS

SEQ ID NO: 512 - protein, 118 aa, synthetic construct
EVQLVESGGGLIQPGGSLRLSCAASGFTVSRNYMSWVRQAPGKGLEWVSIIYAGGNTYYADSVKGRFTISRDNSKNTLYLQMNSLRAEDTGVYYCGRVVPIGNWFDPWGQGTLVTVSS

SEQ ID NO: 513 - protein, 118 aa, synthetic construct
EVQLVESGGGLVQPGGSLRLSCAASGFTFSSYWMSWVRQAPGKGLEWVANIKQDGSEKYYVDSVKGRFTISRDNAKNSLYLQMNSLRAEDTAVYYCARDSNWGVFDYWGQGTLVTVSS

SEQ ID NO: 514 - protein, 118 aa, synthetic construct
EVQLVESGGGLVQPGGSLRLSCAASGFTFSSYWMSWVRQAPGKGLEWVANIKQDGSEKYYVDSVKGRFTISRDNAKNSLYLQMNSLRAEDTAVYYCARDRLTGDLDYWGQGTLVTVSS

SEQ ID NO: 515 - protein, 119 aa, synthetic construct
EVYLVESGGGLVQPGGSLRLSCEASGFTFSRYWMHWVRQVPGKGLVWVSRINIVGSTIDYADSVKGRFTISRDNAKNTLYLQMDSLTAEDTAVYYCAREGDRSDAFAIWGQGTMVTVSS

SEQ ID NO: 516 - protein, 119 aa, synthetic construct
EVQLVESGGGLVKPGGSLRLSCAASGFTFSSYSMNWVRQAPGKGLEWVSSISSSSSYIYYADSVKGRFTISRDNAKNSLYLQMNSLRAEDTAVYYCARQQWLGYYFDYWGQGTLVTVSS

SEQ ID NO: 517 - protein, 119 aa, synthetic construct
EVQLVESGGGLVQPGGSLRLSCAASGFTFSIYWMSWVRQAPGKGLEWVATIKEDGSEKYYVDSVKGRFTISRDNAKNSLFLQMNSLRADDTAVYYCARDSNFLYYFDYWGQGDLVTVSS

SEQ ID NO: 518 - protein, 119 aa, synthetic construct
QVQLVQSGAEVKKPGASVKVSCKASGYTFTSYGISWVRQAPGQGLEWMGWISAYNGNTNYAQKLQGRVTMTTDTSTNTAYMELRSLRSDDTAVYYCARQITGTRGFDYWGQGTLVTVSS

SEQ ID NO: 519 - protein, 119 aa, synthetic construct
QVQLVQSGAEVKKPGASVKVSCKASGYTFTSYDINWVRQATGQGLEWMGWMNPNSGNTGYAQKFQGRVTMTRNTSISTAYMELSSLRSEDTAVYYCARMGYSNYPFDYWGQGTLVTVSS

SEQ ID NO: 520 - protein, 119 aa, synthetic construct
QVQLVQSGSEVKKPGASVKVSCKASGYTFTSYYMHWVRQAPGQGLEWMGIINPSGGSTSYAQKFQGRVTMTRDTSTSTVYMELSSLRSEDTAVYYCARGIPTTVTPDYWGQGTLVTVSS

SEQ ID NO: 521 - protein, 119 aa, synthetic construct
EVQLVESGGGLVQPGGSLRLSCAASGFTFSSYDMHWVRQATGKGLEWVSAIGTAGDTYYPGSVKGRFTISRENAKNSLYLQMNSLRAGDTAVYYCARAGLLTGDAFDIWGQGTMVTVSS

SEQ ID NO: 522 - protein, 119 aa, synthetic construct
EVQLVESGGGLVKPGGSLRLSCAASGFTFSNAWMSWVRQAPGKGLEWVGRIKSKTDGGTTDYAAPVKGRFTISRDDSKNTLYLQMNSLKTEDTAVYYCITGTTFPFDYWGQGTLVTVSS

SEQ ID NO: 523 - protein, 118 aa, synthetic construct
EVQLVESGEGLVQPGGSLRLSCAASGFTFSSHAMHWVRQAPGKGLEYVSAISSNGGNTYYADSVKGRFTISRDNSKNTLYLQVGSLRPEDMAIYYCTKGGVGASFDYWGQGTLVTVSS

SEQ ID NO: 524 - protein, 119 aa, synthetic construct
EVQLVESGGGLVKPGGSLRLSCAASGFTFSSYSMNWVRQAPGKGLEWVSSISSSSSYIYYADSVKGRFTISRDNAKNSLYLQMNSLRAEDTAVYYCARGDYSNYYFDYWGQGTLVTVSS

SEQ ID NO: 525 - protein, 112 aa, synthetic construct
QVQLQQWGAGLLKPSETLSLTCAVYGGSFSGYYWSWIRQPPGKGLEWIGEINHSGSTNYNPSLKSRVTISVDTSKNQFSLKLSSVTAADTAVYYCARWEQPWGQGTLVTVSS

SEQ ID NO: 526 - protein, 119 aa, synthetic construct
QVQLVQSGAEVKKPGASVKVSCKASGYTFTSYYMHWVRQAPGQGLEWMGIINPSGGSTSYAQKFQGRVTMTRDTSTSTVYMELSSLRSEDTAVYYCARRTGTTHYFDYWGQGTLVTVSS

SEQ ID NO: 527 - protein, 119 aa, synthetic construct
QVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARGLWLGLYFDYWGQGTLVTVSS

SEQ ID NO: 528 - protein, 119 aa, synthetic construct
EVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARFLGSSYYFDYWGQGTLVTVSS

SEQ ID NO: 529 - protein, 119 aa, synthetic construct
EVQLVESGGGLVQPGGSLRLSCAASGFTFSSYSMNWVRQAPGKGLEWVSYISSSSSTIYYADSVKGRFTISRDNAKNSLYLQMNSLRDEDTAVYYCARGGAAAGAFDIWGQGTMVTVSS

SEQ ID NO: 530 - protein, 120 aa, synthetic construct
QVQLQESGPGLVKPSQTLSLTCTVSGGSISSGGYYWSWIRQHPGKGLEWIGYIFYSGSTYYNPSLKSRVTISVDTSKKQYSLKLRSVTAADTAVYYCARAEWELLWFDPWGQGTLVTVSS

SEQ ID NO: 531 - protein, 120 aa, synthetic construct
QITLKESGPTLVKPTQTLTLTCTFSGFSLSTSGVGVGWIRQPPGKALEWLALIYWNDDKRYSPSLKSRLTITKDTSKNQVVLTMTNMDPVDTATYFCAHNYFYISGYFYWGQGTLVTVSS

SEQ ID NO: 532 - protein, 120 aa, synthetic construct
QVQLVESGGGVVQPGRSLRLSCAASGFTFSSYGMHWVRQAPGKGLEWVAVISYDGSNKYYADSVKGRFTISRDNSKNTLYLQMNSLRAEDTAVYYCAKDPLRVVNYMDVWGKGTTVTVSS

SEQ ID NO: 533 - protein, 120 aa, synthetic construct
QITLKESGPTLVKPTQTLTLTCTFSGFSLSTSGVGVGWIRQPPGKALEWLALIYWSDDKRYSPSLKNRLTITKDTSKNQVVLTMTNMDPLATATYYCAQTGYNSWSFDYWGQGTLVTVSS

SEQ ID NO: 534 - protein, 120 aa, synthetic construct
QVQLVQSGAEVKKPGASVKVSCKASGYPFTSYGINWVRQAPGQGLEWMGWISAYNSNTNYAEKFQGRVTMTTDTSTTTAYMDLRSLRSDDTAVYYCAREDAWNYGWFDPWGQGTLVTVSS

SEQ ID NO: 535 - protein, 120 aa, synthetic construct
QVQLVQSGAEVKKPGASVKVSCKASGYSFTGYDISWVRQAPRQGLEWMGWISAYNGNTNYAQKFQARVTMTTDTSTSTAYMELRSLRSDDTAVYYCAREILWLGGYFDYWGQGTLVTVSS

SEQ ID NO: 536 - protein, 120 aa, synthetic construct
QVHLVQSGSELKKPGASVKVSCKASGYTFSSYDMNWIRQAPGQGLEWMGWINTNTGNPTYAQGFTGRFVFSLDTSVSTAYLQISSLKAEDTAVYYCAREYSSGWYYFDYWGQGALVTVSS

SEQ ID NO: 537 - protein, 120 aa, synthetic construct
QVQLVQSGAEVKKPGASVKVSCKASGYTFTGYYMHWVRQAPGQGLEWMGWINPNSGGTNYAQKFQGRVTMTRDTSISTAYMELSRLRSDDTAVYYCARERIAVAPPFDYWGQGTLVTVSS

SEQ ID NO: 538 - protein, 120 aa, synthetic construct
QVQLVQSGAEVKKPGASVKVSCKASGYTFTSYDINWVRQATGQGLEWMGWMNPNSGNTGYAQKFQGRVTMTRNTSISTAYMELSSLRSEDTAVYYCARAGWELPEYFQHWGQGTLVTVSS

SEQ ID NO: 539 - protein, 120 aa, synthetic construct
QVQLVQSGAEVKKPGASVKVSCKASGYTFTSYDINWVRQATGQGLEWMGWMNPNSGNTGYAQKFQGRVTMTRNTSISTAYMELSSLRSEDTAVYYCARGGDDYSNLFDYWGQGTLVTVSS

SEQ ID NO: 540 - protein, 120 aa, synthetic construct
QVQLVQSGAEVKKPGSSVKVPCKASGDTFSNFAINWVRQAPGQGLEWMGGIIPIFATANYAQNFQGRVTITADESTSAAYMEVSSLRFEDTAVYYCARTPLGIGRSFDLWGQGTMVTVSS

SEQ ID NO: 541 - protein, 120 aa, synthetic construct
EVHLVESGGGLVKPGGSLRLSCAASGFTFSNAWMSWVRQAPGKGLEWVGRIKRKTDGGTTDFASPVKGRFTISRDDSNNTLYLQMNSLKTEDTAVYYCTTASTVTTGDYWGQGTLVTVSS

SEQ ID NO: 542 - protein, 119 aa, synthetic construct
QVQLQQSGPGLVKPSQTLSLTCAISGDSVSSNSAAWNWIRQSPSRGLEWLGRTYYRSKWYNDYAVSVKSRITINPDTSKNQFSLQLNSVTPEDTAVYYCARERTEIDYWGQGTLVTVSS

SEQ ID NO: 543 - protein, 120 aa, synthetic construct
EVQLVESGGGLVKPGGSLRLSCAASGFTFNNAWMIWVRQAPGKGLEWVGRIKSKTDGGTTDYGAPVKGRFTISRDDSKNTLYLQMNSLKTEDTAVYYCTTGRYFDWFDYWGQGTLVIVSS

SEQ ID NO: 544 - protein, 120 aa, synthetic construct
EVQLVESGGGLVKPGGSLRLSCAASGFTFSNAWMSWVRQAPGKGLEWVGRIKSKTDGGTTDYAAPVKGRFTISRDDSKNTLYLQMNSLKTEDTAVYYCTTASGSYWFDPWGQGTLVTVSS

SEQ ID NO: 545 - protein, 120 aa, synthetic construct
QVQLVESGGGVVQPGRSLRLSCAASGFTFSSYGMHWVRQAPGKGLEWVAVISYDGSNKYYADSVKGRFTISRDNSKNTLYLQMNSLRAEDTAVYYCAKGNWNYGDAFDIWGQGTMVTVSS

SEQ ID NO: 546 - protein, 120 aa, synthetic construct
QVQLVESGGGVVRPGGSLRLSCAASGFTFDDYGMSWVRQAPGKGLEWVSGINWNGGSTGYADSVKGRFTISRDNAKNSLYLQMNSLRAEDTALYYCARENYDFWSGFDPWGQGTLVTVSS

SEQ ID NO: 547 - protein, 119 aa, synthetic construct
QVHLQQSGPGLVKPSQTLSLTCAISGDSVSSNSAAWNWIRQSPSRGLEWLGRTYYRSKWYNGYAESVKSRITINPDTSKNQFSLQLNSVTPEDTAVYYCAREDRGFDYWGQGTLVTVSS

SEQ ID NO: 548 - protein, 120 aa, synthetic construct
EVQLVESGGGLVQPGRSLRLSCAASGFTFDDYAMHWVRQAPGKGLEWVSGISWNSGSIGYADSVKGRFTISRDNAKNSLYLQMNSLRAEDTALYYCAKRAVVTDYYMDVWGKGTTVTVSS

SEQ ID NO: 549 - protein, 120 aa, synthetic construct
EVQLVESGGGLVQPGGSLRLSCAASGFTFSSYSMNWVRQAPGKGLEWVSYISSSSNTIYYADSVKGRFTISRDNAKNSLYLQMSSLRDEDTAVYYCARTSSWSYDAFDIWGQGTMVTVSS

SEQ ID NO: 550 - protein, 121 aa, synthetic construct
QVQLVQSGAEVKKPGASVKVSCKASGYTFTSYYMHWVRQAPGQGLEWMGIINPSGGSTSYAQKFQGRVTMTRDTSTSTVYMELSSLRSEDTAVYYCARERGHTVTPYFDYWGQGTLVTVSS

SEQ ID NO: 551 - protein, 121 aa, synthetic construct
EVQLVESGGGLVQPGGSLRLSCAASGFNFSSYNMNWVRQTPGKGLEWVSYISNTGNTIYYVDSVKGRFTISRDNAKNSLYLQLNSLRDEDTAVYFCARDGPQVGATDFDYWGQGTLVTVSS

SEQ ID NO: 552 - protein, 121 aa, synthetic construct
EVQLVESGGGLVKPGGSLRLSCAASGFTFSNAWMSWVRQAPGKGLEWVGRIKRKTDGGTTDYAAPVKGRFTISRDDSKNTLYLQMNSLKTEDTAVYYCTTEYSSSENFDYWGQGTLVTVSS

SEQ ID NO: 553 - protein, 121 aa, synthetic construct
EVQLVESGGGLVQPGGSLRLSCAASGFTFSSYWMHWVRQAPGKGLVWVSRINSDGSSTSYADSVKGRFTISRDNAKNTLYLQMNSLRAEDTAVYYCARDLGAARPRGFDYWGQGTLVTVSS

SEQ ID NO: 554 - protein, 121 aa, synthetic construct
EVQLVESGGGLVQPGGSLRLSCAASGFTFSSYAMSWVRQAPGKGLEWVSAISGSGGSTYYADSVKGRFTISRDNSKNTLYLQMNSLRAEDTAVYYCAKEGDSGYDSAFDIWGQGTMVTVSS

SEQ ID NO: 555 - protein, 121 aa, synthetic construct
QVQLQESGPGLVKPSGTLSLTCAVSGGSISSNNWWSWVRQPPGKGLEWIGEIYHSGSTNYNPSLKSRVTISVDKSKNQFSLKLSSVTAADTAVYYCARVLNWNYGDAFDIWGQGTMVTVSS

SEQ ID NO: 556 - protein, 121 aa, synthetic construct
QVQLQESGPGLVKPSGTLSLTCAVSGGSISSSNWWSWVRQPPGKGLEWIGEIYHSGSTNYNPSLKSRVTISVDKSKNQFSLKLSSVTAADTAVYYCARDPSIVGATAFDIWGQGTMVTVSS

SEQ ID NO: 557 - protein, 121 aa, synthetic construct
QVQLQESGPGLVKPSGTLSLTCAVSGGSIISSNWWSWVRQSPGKGLGWIGEIYHSGSTTYNPSLKSRVTISVDKSKNQFSLKLSSVTAADTALYYCARSHIVGVNGGFDYWGQGTLVTVSS

SEQ ID NO: 558 - protein, 121 aa, synthetic construct
EVQLVESGGGLVKPGGSLRLSCAASGFTFSSYSMNWVRQAPGKGLEWVSSISSSSSYIYYADSVKGRFTISRDNAKNSLYLQMNSLRAEDTAVYYCARDRYNWNYRAFDIWGQGTMVTVSS

SEQ ID NO: 559 - protein, 121 aa, synthetic construct
EVQLVESGGGLVQPGGSLRLSCAASGFTFSSYWMSWVRQAPGKGLEWVANIKQDGSEKYYVDSVKGRFTISRDNAKNSLYLQMNSLRAEDTAVYYCARDLGRGTISWFDPWGQGTLVTVSS

SEQ ID NO: 560 - protein, 121 aa, synthetic construct
QITLKESGPTLVKATQTLTLTCTFSGFSLNSSGVGVVWIRQPPGKALEWLALIYWNGDKRYSQSLKNRLTITEDTSKNQVVLAMTNMDPVDTATYYCTQTGYDSRWSFAYWGQGTLVTVSS

SEQ ID NO: 561 - protein, 121 aa, synthetic construct
QGQLVQSGAEVKKPGASVKVSCKTSGYIFMNYGITWVRHAPGQGLEWMGWISAYNGNTNYAQKVQGRVTMTTDTSTSTANMELRSLRSDDTAVYYCAREGQWRGRGWFALWGQGTQVTVSS

SEQ ID NO: 562 - protein, 121 aa, synthetic construct
QVQLVQSGSELKKPGASVKVSCKASGYTFTNYAMNWVRQAPGQGLEWMGWINTNTGKPTYAQGFTGRFVFSLDTSVSTAHLQISGLKAEDTAVYYCARERYFEDFHYMDVWGKGTTVTVSS

SEQ ID NO: 563 - protein, 121 aa, synthetic construct
QVQLVQSGAEVKKPGASVKVSCKASGYTFTDNYIHWVRRAPGQGLEWMGWLNPNSGGTNFAQKFQGRVTMTRDTSISSVYMILSSLRSDDTAVYYCARSSWLQLTYYFDYWGQGTLVTVSS

SEQ ID NO: 564 - protein, 121 aa, synthetic construct
QVQLVQSGAEVKKPGASVKVSCKASGYTFTSYYIHWVRQAPGQGLEWMGIINPSGGSTSYAQKFQGRVTMTRDTSTSTVYMEVSSLRSEDTAVYYCAREGLQLGSNWFDPWGQGTLVTVFS

SEQ ID NO: 565 - protein, 121 aa, synthetic construct
EVQLVESGGGLVQPGGSLRLSCAASGFTFSSYSMNWVRQAPGKGLEWVSYISSSSSTIYYADSVKGRFTISRDNAKNSLYLQMNSLRDEDTAVYYCARNDILTGEDAFDIWGQGTMVTVSS

SEQ ID NO: 566 - protein, 121 aa, synthetic construct
EVQMVESGGGLVQPGGSLRLSCAASGFTFSNYAMSWVRQAPGKGLGWVSGISGSGGRTYYADSVKGRFTISRDNSKNTLYLQMNSLRAEDTAVYYCAKESIIVGATMFDYWGQGTLVTVSS

SEQ ID NO: 567 - protein, 121 aa, synthetic construct
QVQLVESGGGVVQPGRSLRLSCAASGFTFSSYGMHWVRQAPGKGLEWVAVISYDGSNKYYADSVKGRFTISRDNSKNTLYLQMNSLRAEDTAVYYCAKGIAALGYYYMDVWGKGTTVTVSS

SEQ ID NO: 568 - protein, 121 aa, synthetic construct
EVQLVQSGAEMKKPGESLKISCKDSGYRFSNYWIGWVRQLPGKGLEWMGIIYPGDSDTRYSPSFQGQVTISADKSINTAYLQWNSLKASDTAIYYCAKRRITGSHNWFDPWGQGTLVTVSS

SEQ ID NO: 569 - protein, 121 aa, synthetic construct
QVQLVQSGSELKKPGASVKVSCKASGYTFTSYAMNWVRQAPGQGLEWMGWINTNTGNPTYAQGFTGRFVFSLDTSVSTAYLQISSLKAEDTAVYYCARGGTIFGVVNFDYWGQGTLVTVSS

SEQ ID NO: 570 - protein, 121 aa, synthetic construct
QVQLVESGGGVVQPGRSLRLSCAASGFTFSSYVMHWVRQAPGKGLEWVAVIWYDGSNKYFADSVKGRFTISRDNSNNTLYLQMNSLRAEDTGVYYCLSRSGYSAHNDGDYWGQGTLVTVSS

SEQ ID NO: 571 - protein, 121 aa, synthetic construct
QVQLVQSGAEVKKPGASVKVSCKASGYTFTGYYIFWVRQAPGQGLEWMGWINPNSGGTNYAQKFQGRVTMTRDTSITTAYMELSRLRHDDTAVYYCTKEGLVVRPDWFDPWGQGTLVTVSS

SEQ ID NO: 572 - protein, 120 aa, synthetic construct
QVQLQQSGPGLVKPTQTLSLTCAISGDSVSSNSAAWNWIRQSPSRGLEWLGRTYYRSKWYNDYAVSVRSRITINPDTSKNQFSLHLNSVTPEDTAVYYCARKGRDVFDIWGQGTMVTVSS

SEQ ID NO: 573 - protein, 121 aa, synthetic construct
QVQLVQSGAEVKKPGASVKVSCKASGYTFTSYGISWVRQAPGQGLEWMGWISAYNGNTNYAQKLQGRVTMTTDTSTSTAYMELRSLRSDDTAVYYCAREGSGSYSDAFDIWGQGTMVTVSS

SEQ ID NO: 574 - protein, 121 aa, synthetic construct
QITLKESGPTLVKPTQTLTLTCTFSGFSITTSGVGVGWIRQPSGKALEWLALIYWNDDKRYSPSLKSRLTITKDTSKNQVVLTMTNMDPVDTATYYCTHTEYRNTWCVDYWGQGTLVTVSS

SEQ ID NO: 575 - protein, 121 aa, synthetic construct
QITLKESGPTLVKPTQTLTLTCTFSGFSLSTSGVGVGWIRQPPGKALEWLALIYWNDDKRYSPSLKSRLTITKDTSKNQVVLTMTNMDPVDTATYYCAHSPYTSGWPFDYWGQGTLVTVSS

SEQ ID NO: 576 - protein, 121 aa, synthetic construct
QVQLVQSGAEVKKPGASVKVSCKASGYTFTSYDINWVRQATGQGLEWMGWMNPNSGNTGYAQKFQGRVTMTRNTSISTAYMELSSLRSEDTAVYYCARVSYSSSWSLFDYWGQGTLVTVSS

SEQ ID NO: 577 - protein, 122 aa, synthetic construct
QVTLRESGPALVKPTQTLTLTCTFSGFSLSTSGMSLSWIRQPPGKALEWLALIDWDDDQYYSTSLKTRLTISKDTSKNQVVLSMTNMDPVDTATYYCARIRGVGALDGFDFWGQGTMVTVSS

SEQ ID NO: 578 - protein, 122 aa, synthetic construct
QVQLVQSGAEVKKPGASVKVSCKASGYTFTSYGISWVRQAPGQGLEWMGWISGYKGNTNCAQELQGRVTITSDTSTSTAYMELRSLRSDDTAVYYCARPLDYGDYEGWFDPWGQGTLVTVSS

SEQ ID NO: 579 - protein, 122 aa, synthetic construct
QVQLAQSGIEMRKPGASVKVSCRASGDTFTNCGFGWVRQAPGQGLEWMGWISAYNGNTNYAQKFQGRVTMTTDTSTSTAYMELRSLRSDDTAVYYCAREGRTNYFYYYMDVWGKGTTVTVSS

SEQ ID NO: 580 - protein, 122 aa, synthetic construct
EVQLVESGGGLVQPGRSLRLSCAASGFTFDDYAMHWVRQAPGKGLEWVSGISKNSGSIGYADSVKGRFTISRDNAKKSLYLQMNSLRVEDTALYYCAKDITASGDYYYMDVWGKGTTVTVSS

SEQ ID NO: 581 - protein, 122 aa, synthetic construct
EVQLVESGGGLVQPGGSLRLSCAASGFTFSSYSMNWVRQAPGKGLEWVSYISSSSSTIYFADSVKGRFTISRDNAKNSLYLQMNSLRDEDTAVYYCARDRVYNWNDGAFDIWGQGTMVTVSS

SEQ ID NO: 582 - protein, 122 aa, synthetic construct
EVQLVESGGGLVQPGGSLRLSCAASGFTFSSYAMSWVRQAPGKGLEWVSAISGSGGSTYYADSVKGRFTISRDNSKNTMYLQMNSLRAEDTAVYYCAKDQRYNWNSWYFDLWGRGTLVTVSS

SEQ ID NO: 583 - protein, 122 aa, synthetic construct
QVQLVESGGGVVQPGRSLRLSCAASGFTFSSYGMHWVRQAPGKGLEWVAVIWYDGSNKYYADSVKGRFTISRDNSKNTLYLQMNSLRAEDTAVYYCARDHGGVTTYNWFDPWGQGTLVTVSS

SEQ ID NO: 584 - protein, 122 aa, synthetic construct
QVQLVQSGAEVKKPGASVKVSCKASGYTFTGYYMHWVRQAPGQGLEWMGWINPNSGGTNYAQKFQGRVTMTRDTSISTAYMELSRLRSDDTAVYYCARDRMVRGVLDAFDIWGQGTMVTVSS

SEQ ID NO: 585 - protein, 122 aa, synthetic construct
EVQLVESGGGLVQPGGSLRLSCAASGFTFSSYSMNWVRQAPGKGLEWVSYISSSSSTIYYADSVKGRFTISRDNAKNSLYLQMNSLRDEDTAVYYCVRGYSSGWYNWYFDLWGRGTLVTVSS

SEQ ID NO: 586 - protein, 122 aa, synthetic construct
QVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARKVPGIAAAGAFDYWGQGTLVTVSS

SEQ ID NO: 587 - protein, 122 aa, synthetic construct
QVQLVQSGSELKKPGASVKVSCKASGYTFNSYAMNWVRQAPGLGLEWMGWINTNTGNPTYAQGFSGRFVFSLDTSVNTAYLQISSLQAEDTAVYFCARGGYGYNFWIRFDPWGQGTLVTVSS

SEQ ID NO: 588 - protein, 116 aa, synthetic construct
QLQLQESGPGLVKPSETLSLTCTVSGGSISRSSYYWGWIRQPPGRGLEWIGSIYYSGSTYYNPSLKSRVTISVDTSKNQFSLKLSSVTAADTGVYYCASYWNFDYWGRGTLVTVSS

SEQ ID NO: 589 - protein, 123 aa, synthetic construct
QVQLQESGPGLVKPSGTLSLTCAVSGGSISSSFWLSWVRQPPGKGLEWIGEIYHSGSTNYNPSLKSRVTISVDKSKNQFSLKLTSVTAADTAVYSCARVLGYSYGYRRWFDPWGQGTLVTVSS

SEQ ID NO: 590 - protein, 123 aa, synthetic construct
EVQLVESGGGLVNPGGSLRLSCAASGFTFSNAWMSWVRQGPGRGLEWVGRIKSKSDGETIDYAAPVKGRFSFSRDDAENTLYLEMNSLKTEDTAVYYCTTEGSFNFYYFMDVWGKGTAVTVSS

SEQ ID NO: 591 - protein, 123 aa, synthetic construct
QVQLQESGPGLVKPSETLSLTCTVSGGSISSYYWSWIRQPPGKGLEWIGHIYYSGSTNYNPSLKSRVTISVDTSKNQFSLKLSSVTAADTAVYYCARDPFYYDFSDYYYMDVWGKGTTVTVSS

SEQ ID NO: 592 - protein, 123 aa, synthetic construct
EVQLVESGGGLVQPGGSLRLSCAASGFTFSSYAMSWVRQAPGKGLEWVSAISGSGGSTYYADSVKGRFTISRDNSKNTLYLQMNSLRAEDTAVYYCAKNEARDYYGSGSFDYWGQGTLVTVSS

SEQ ID NO: 593 - protein, 123 aa, synthetic construct
EVQLVESGGGVVRPGGSLRLSCAASGFTFGDFGMSWVRQAPGKGLEWVSGINWNGGSTGYADSVKGRFTISRDNAKNSLYLQMNSLRAEDTALYYCASLVGATDYYFYYMDVWGKGTTVTVSS

SEQ ID NO: 594 - protein, 122 aa, synthetic construct
QVQLQQSGPGLVKPSQTLSLTCAISGDSVSSNSAAWNWIRQSPSRGLEWLGRTYYRSKWYNDYAVSVKSRITINPDTSKNQFSLQLNSVTPEDTAVYYCARKWELLDAFDIWGQGTMVTVSS

SEQ ID NO: 595 - protein, 123 aa, synthetic construct
EVQLVESGGGLVQPGGSLRLSCAASGFTFSSYSMNWVRQAPGKGLEWVSYISSSSSTIYYADSVKGRFTISRDNAKNSLYLQMNSLRDEDTAVYYCAREERDDYSNYGYFQHWGQGTLVTVSS

SEQ ID NO: 596 - protein, 122 aa, synthetic construct
QVQLQQSGPGLVKPSQTLSLTCAISGDSVSSNSATWNWIRQSPSRGLEWLGRSYYMSKWYNDYAVSVKSRITINPDTSKNQFSLQLNSVTPEDTAVYYCARGDWNYGVLDSWGQGTLVTVSS

SEQ ID NO: 597 - protein, 123 aa, synthetic construct
QVQLVQSGAEVKKPRASVKVSCEASGYTFTTYGISWVRQAPGQGLEWMGWISAYNGNTKYTQKLQGRVAMTTDTSTSTAYMEVRSLRSDDTAVYYCARSGYNWNYDYYFMDVWGTGTTVTVSS

SEQ ID NO: 598 - protein, 124 aa, synthetic construct
EVQLVESGGGVVRPGGSLRLSCAASGFTFDDYGMSWVRQAPGKGLEWVSGINWNGGSTGYADSVKGRFTISRDNAKNSLYLQMNSLRAEDTALYYCARDGCSSTSCYGNWFDPWGQGTLVTVSS

SEQ ID NO: 599 - protein, 123 aa, synthetic construct
QVQLQQSGPGLVKPSQTLSLTCAISGDSVSSNSAAWNWIRQSPSRGLEWLGRTYYRSKWYSDYAVSVKSRITINPDTSKNQFSLQLNSVTPEDTAVYYCARVDFGIVGAIDYWGQGTLVTVSS

SEQ ID NO: 600 - protein, 124 aa, synthetic construct
EVQLVESGGGLVKPGGSLRLSCAASAFTFSNYNMNWVRQAPGKGLEWVSSISSSTSYIYYADSVKGRFTVSRDNAKNSLYLQMNSLRAEDTAVYYCARDRDDFWSGYSPYFDYWGQGTLVTVSS

SEQ ID NO: 601 - protein, 124 aa, synthetic construct
EVQLVESGGGLVKPGGSLRLSCAASGFTFSSYSMNWVRQAPGKGLEWVSSISSSSSYIYYADSVKGRFTISRDNAKNSLYLQMNSLRAEDTAVYYCAREKYDILTGYSPYFDYWGQGTLVTVSS

SEQ ID NO: 602 - protein, 124 aa, synthetic construct
EVQLVESGGGLVKPGGSLRLSCAASGFTFSNAWMSWVRQAPGKGLEWVGRIKSKTDGGTTDYAAPVKGRFTISRDDSKNTLYLQMNSLKTEDTAVYYCTTDQVSGSYGDAFDIWGQGTMVTVSS

SEQ ID NO: 603 - protein, 124 aa, synthetic construct
EVQMVESGGGLVQPGGSLRLSCAASGFTFSSHVMSWVRQAPGKGLEWVSVISGSESSTYYADSVKGRFTISSDNSKNTLYLQMNSLRAEDTAIYYCAKRAGSGTYYRGYYFDYWGQGTLVTVSS

SEQ ID NO: 604 - protein, 124 aa, synthetic construct
LVQLVESGGGVVQPGRSLRLSCAASGFTFSSYGMHWVRQAPGKGLEWVTLIWYDGSNTYYAESVKGRFTISRDNSKSTLYLHMNSLRAEDSAVYYCAGTYYYDSSGYLNYMDVWGKGTTVTVSS

SEQ ID NO: 605 - protein, 117 aa, synthetic construct
QLQLQESGPGLVKPSETLSLTCTVSGGSISSSSYYWGWIRQPPGKGLEWIGSIHYSGSTYYNPSLKSRVTTSVDTSKNQFSLKLSSVTAADTAVYYCASEGPYFDYWGQGTLVTVSS

SEQ ID NO: 606 - protein, 124 aa, synthetic construct
QVQLVQSGAEVKKPGASVKVSCKASGYSFSSYGIGWVRQAPGQGLEWMGWISGYNGNTNYAQKFQGRVTMTTDTSTSTAHMEVKSLRSDDTAAYYCARAYCGGDCYYSNAFDAWGQGTMVTVSS

SEQ ID NO: 607 - protein, 124 aa, synthetic construct
EVQLVESGGGLVKPGGSLRLSCAASGFTFSNAWMSWVRQAPGKGLEWVGRIKSKTDGGTTDYAAPVKGRFTISRDDSKNTLYLQMNSLKTEDTAVYYCTTDRVTIFGLARMDVWGKGTTVTVSS

SEQ ID NO: 608 - protein, 125 aa, synthetic construct
EVQLVESGGGLVQPGGSLRLSCAASGFTFSTYSVKWVRQAPGKGLEWVSYISSGSSTIYYADSVKGRFTISRDNAKNSLYLQMNSLRDEDTAVYYCARDPTTIFGVVPYYYMDVWGTGTTVTVSS

SEQ ID NO: 609 - protein, 125 aa, synthetic construct
EVQLVESGGGLVKPGGSLRLSCAASGFTFSNAWMSWVRQAPGKGLEWVGRIKSKTDGGTTDYAAPVKGRFTISRDDSKNTLYLQMNSLKTEDTAVYYCTTDRDYYGSGSYYFDYWGQGTLVTVSS

SEQ ID NO: 610 - protein, 118 aa, synthetic construct
QLQLQESGPGLVKPSETLSLTCTVSGGSITTRSYYWGWLRQPPGKGLEWIGTFYYSGNTYYNPSLQSRVSISVDASKNQFSLQLSSVTAADTAVFYCAREDLIGNDYWGQGTLVTVSS

SEQ ID NO: 611 - protein, 124 aa, synthetic construct
QVHLQQSGPGLVKPSQTLSLTCAISGDSVSSNSAAWNWIRQSPSRGLEWLGRTYYRSKWYNDYAVSVKSRITINSDTSKNQFSLQLNSVTPEDTAVYYCSRDRLIVGASYFDLWGRGTLVTVSS

SEQ ID NO: 612 - protein, 125 aa, synthetic construct
EVQLVESGGGVVRPGGSLRLSCAASGFTFDDYGMSWVRQAPGKGLEWVSGINWNGGSTGYADSVKGRFTISRDNAKNSLYLQMNSLRAEDTALYYCAREKAPAHRSSWSWYFDLWGRGTLVTVSS

SEQ ID NO: 613 - protein, 125 aa, synthetic construct
QVQLVHSGAEVKKPGASVKVSCKASGYTFTGNYIHWVRQAPGQGLEWMGWINPTSGVTNYAQKFQGRVTLTRDTSISTAYMELSRLRSDDTAVYYCTREGIAAANPGYFYYMDVWGKGTTVTVSS

SEQ ID NO: 614 - protein, 126 aa, synthetic construct
QVQLVQSGAEVKKPGASVKVSCKASGYTFTDYYMHWVRQAPGQGLEWMGWINPNSGGTNYAQKFQGRVTMTRDTSISTAYMELSRLRSDDTAVYFCARCDMVRGVIDHYYNYMDVWGKGTTVTVSS

SEQ ID NO: 615 - protein, 126 aa, synthetic construct
QMQLQGSGPGLMKPSETLSLTCTVSGGSISSRSYYWGWIRQPPGKGLEWIGSVFYSGSTYYNPSLKSRVTISVDTSKNQFSLKVISVTAADTAVYYCVRQTYDSWTGYSFFYFDYWGQGTLVTVSS

SEQ ID NO: 616 - protein, 127 aa, synthetic construct
EVQLVESGGGLVQPGGSLKLSCAASGFTFSGSAMHWVRQASGKGLEWVGRIRSKANSYATAYAASVKGRFTISRDDSKNTAYLQMNSLKTEDTAVYYCTRPMITFGGVIVYDAFDIWGQGTMVTVSS

SEQ ID NO: 617 - protein, 120 aa, synthetic construct
QVQLQQWGAGLLKPSETLSLTCAVYGGSFSGYYWSWIRQPPGKGLEWIGEINHSGSTNYNPSLKSRVTISVDTSKNQFSLKLSSVTAADTAVYYCARGWGSSSWYYFDYWGQGTLVTVSS

SEQ ID NO: 618 - protein, 120 aa, synthetic construct
QVQLQQWGAGLLKPSETLSLTCAVYGGSFSGYYWSWIRQPPGKGLEWIGEINRSGSTNYNPSLKTRVTISVDTSKNQFSLQLSSVTAADTAVYYCARGIFGVGGNWFDPWGQGTLVTVSS

SEQ ID NO: 619 - protein, 120 aa, synthetic construct
QLQLQESGPGLVKPSETLSLTCTVSGGSISSSSYYWGWIRQPPGKGLEWIGSIYYSGSTYYNPSLKSRVTISVDTSKNQFSLKLSSVTAADTAVYYCARYSSSWSGFDYWGQGTLVTVSS

SEQ ID NO: 620 - protein, 120 aa, synthetic construct
QLQLQESGPGLVKPSETLSLTCTVSGGSISSSSYYWGWIRQPPGKGLEWIGSIYYSGSTYYNPSLKSRVTISVDTSKNQFSLKLSSVTAADTAVYYCARGGSYYVYFDYWGQGTLVTVSS

SEQ ID NO: 621 - protein, 128 aa, synthetic construct
KVQLVESGGGLVQPGGSLRLSCAASGFTFRSYWMSWVRQAPGKGLEWVANINQDGSEKYYVDSVKGRFTISRDNAKNSLYLHMNSLRAEDTAVYYCSRDTDCSSTSCYFNWNPFFDYWGQGTLVTVSS

SEQ ID NO: 622 - protein, 122 aa, synthetic construct
QLQLQESGPGLVKPSETLSLTCTVSGGSINSSNFYWGWIRQPPGKGLEWFGSIFYSGFTYYNPSLKSRVTISVDTSKNQFSLKLTSVTAADTAVYYCARGGYSYGLNWFDPWGQGTLVTVSS

SEQ ID NO: 623 - protein, 125 aa, synthetic construct
QLQLQESGPGLVKPSETLSLTCTVSGGSISSSSYYWGWIRQPPGKGLEWIGSIYYSGSTYYNPSLKSRVTISVDTSKNQFSLKLSSVTAADTAVYYCARTYYDFWSGYLNWFDPWGQGTLVTVSS

SEQ ID NO: 624 - protein, 125 aa, synthetic construct
QVQLQQWGAGLLKPSETLSLTCAVYGGSFSGYYWSWIRQPPGKGLEWIGEINRGGSTNYNPSLKSRVTISVDTSKNQFSLKLSSVTAADTAVYYCARWRNYYDSSGSPYWYFDLWGRGSLVTVSS

SEQ ID NO: 625 - protein, 125 aa, synthetic construct
QLQLQESGPGLVKPSETLSLTCTVSGGSISSSGYYWGWIRQSPGKGLEWIGSFYYSGSTYYNPSLKSRVTISVDTSKNQFSLKLSSVTAADTAVYYCARQGRITMVRGVIPFDYWGQGTLVTVSS

SEQ ID NO: 626 - protein, 128 aa, synthetic construct
QVQLQQWGAGLLKPSETLSLTCAVYGGSFSGYYWSWIRQPPGKGLEWIGEINHSGSTNYNPSLKSRVTISVDTSKNQFSLKLSSVTAADTAVYYCAGGYCSSTSCRYNWNYGGWFDPWGQGTLVTVSS

SEQ ID NO: 627 - protein, 110 aa, synthetic construct
QSALTQPASVSGSPGQSITISCTGTSSDVGGYNYVSWYQQHPGKAPKLMIYEVSNRPSGVSNRFSGSKSGNTASLTISGLQAEDEADYYCSSYTSSSTWVFGGGTKLTVL

SEQ ID NO: 628 - protein, 114 aa, synthetic construct
QSALTQPASVSGSPGQSITISCTGTSSDVGGYNYVSWYQQHPGKAPKLMIYDVSKRPSGVSNRFSGSKSGNTASLTISGLQAEDEADYYCCSYAGRSTLGIDWVFGGGTKVTVL

SEQ ID NO: 629 - protein, 106 aa, synthetic construct
SYELTQPPSVSVSPGQTASITCSGDKLGDKYACWYQQKPGQSPVLVIYQDSKRPSGIPERFSGSNSGNTATLTISGTQAMDEADYYCQAWDSSTYVFGTGTKVTVL

SEQ ID NO: 630 - protein, 106 aa, synthetic construct
SYELTQPSSVSVSPGQTARITCSGDVLAKKYARWFQQKPGQAPVLVIYKDSERPSGIPERFSGSSSGTTVTLTISGAQVEDEADYYCYSAADNNLVFGGGTKLTVL

SEQ ID NO: 631 - protein, 108 aa, synthetic construct
SSELTQDPAVSVALGQTVRITCQGDSLRSYYASWYQQKPGQAPVLVIYGKNNRPSGIPDRFSGSSSGNTASLTITGAQAEDEADYYCNSRDSSGNHRVFGGGTKLTVL

SEQ ID NO: 632 - protein, 110 aa, synthetic construct
QSALTQPRSVSGSPGQSVTISCTGTSSDVGGYNYVSWYQQHPGKAPKLMIYDVSKRPSGVPDRFSGSKSGNTASLTISGLQAEDEADYYCCSYAGSYTWVFGGGTKLTVL

SEQ ID NO: 633 - protein, 110 aa, synthetic construct
QSALTQPPSASGSPGQSVTISCTGTSSDVGGYNYVSWYQQHPGKAPKLMIYEVSKRPSGVPDRFSGSKSGNTASLTVSGLQAEDEADYYCSSYAGSNNLVFGGGTKLTVL

SEQ ID NO: 634 - protein, 110 aa, synthetic construct
QSALTQPASVSGSPGQSITISCTGTSSDVGGYNYVSWYQQHPGKAPKLMIYEVSNRPSGVSNRFSGSKSGNTASLTISGLQAEDEADYYCSSYTSSSTYVFGTGTKVTVL

SEQ ID NO: 635 - protein, 111 aa, synthetic construct
QSALTQPASVSGSPGQSITISCTGTSSDVGGYNYVSWYQQHPGKAPKLMIYDVSKRPSGVSNRFSGSKSGNTASLTISGLQAEDEADYYCCSYAGSSTYVVFGGGTKLTVL

SEQ ID NO: 636 - protein, 108 aa, synthetic construct
SSELTQDPAVSVALGQTVRITCQGDSLRSYYASWYQQKPGQAPVLVIYGKNNRPSGIPDRFSGSSSGNTASLTITGAQAEDEADYYCNSRDSSGNHVVFGGGTKLTVL

SEQ ID NO: 637 - protein, 108 aa, synthetic construct
SYVLTQPPSVSVAPGKTARITCGGNNIGSKSVHWYQQKPGQAPVLVIYYDSDRPSGIPERFSGSNSGNTATLTISRVEAGDEADYYCQVWDSSSDHPVFGGGTKLTVL

SEQ ID NO: 638 - protein, 115 aa, synthetic construct
QAVLTQPASLSASPGASASLTCTLRSGINVGTYRIYWYQQKPGSPPQYLLRYKSDSDKQQGSGVPSRFSGSKDASANAGILLISGLQSEDEADYYCMIWHSSAVVFGGGTKLTVL

SEQ ID NO: 639 - protein, 107 aa, synthetic construct
SSELTQDPAVSVALGQTVRITCQGDSLRSYYASWYQQKPGQAPVLVIYGKNNRPSGIPDRFSGSSSGNTASLTITGAQAEDEADYYCNSRDSSGNWVFGGGTKLTVL

SEQ ID NO: 640 - protein, 109 aa, synthetic construct
SYELTQPPSVSVSPGQTARITCSGDALPKKYAYWYQQKSGQAPVLVIYEDSKRPSGIPERFSGSSSGTMATLTISGAQVEDEADYYCYSTDSSGNHSWVFGGGTKLTVL

SEQ ID NO: 641 - protein, 110 aa, synthetic construct
QSALTQPASVSGSPGQSITISCTGTSSDVGGYNYVSWYQQHPGKAPKLMIYEVSNRPSGVSNRFSGSKSGNTASLTISGLQAEDEADYYCSSYTSSSTLVFGGGTKLTVL

SEQ ID NO: 642 - protein, 116 aa, synthetic construct
QAVLTQPASLSASPGASASLTCTLRSGINVGTYRIYWYQQKPGSPPQYLLRYKSDSDKQQGSGVPSRFSGSKDASANAGILLISGLQSEDEADYYCMIWHSSAYVVFGGGTKLTVL

SEQ ID NO: 643 - protein, 107 aa, synthetic construct
SYELTQPPSVSVSPGQTASITCSGDKLGDKYACWYQQKPGQSPVLVIYQDSKRPSGIPERFSGSNSGNTATLTISGTQAMDEADYYCQAWDSSTAWVFGGGTKLTVL

SEQ ID NO: 644 - protein, 108 aa, synthetic construct
SYELTQPPSVSVSPGQTARITCSGDALPKKYAYWYQQKSGQAPVLVIYEDSKRPSGIPERFSGSSSGTMATLTISGAQVEDEADYYCYSTDSSGNHKVFGGGTKLTVL

SEQ ID NO: 645 - protein, 108 aa, synthetic construct
SSEMTQDPAVSVALGQTVRITCQGDSLRSYYASWYQQKPGQAPVLVIYGKNNRPSGIPDRFSGSSSGNTASLTITGAQAEDEADYYCNSRDSSGNHWVFGGGTKLTVL

SEQ ID NO: 646 - protein, 109 aa, synthetic construct
QSALTQPRSVSGSPGQSVTISCTGTSSDVGGYNYVSWYQQHPGKAPKLMIYDVSKRPSGVPDRFSGSKSGNTASLTISGLQAEDEADYYCCSYAGSSWVFGGGTKLTVL

SEQ ID NO: 647 - protein, 110 aa, synthetic construct
QSALTQPASVSGSPGQSITISCTGTSSDVGGYNYVSWYQQHPGKAPKLMIYEVSNRPSGVSNRFSGSKSGNTASLTISGLQAEDEADYYCSSYTSSSTLVFGTGTKVTVL

SEQ ID NO: 648 - protein, 111 aa, synthetic construct
QSALTQPASVSGSPGQSITISCTGTSSDVGGYNYVSWYQQHPGKAPKLMIYDVSKRPSGVSNRFSGSKSGNTASLTISGLQAEDEADYYCCSYAGSSTFVVFGGGTKLTVL

SEQ ID NO: 649 - protein, 111 aa, synthetic construct; identical to SEQ ID NO: 648

SEQ ID NO: 650 - protein, 114 aa, synthetic construct
QSALTQPASVSGSPGQSITISCTGTSSDVGGYNYVSWYQQHPGKAPKLMIYDVSKRPSGVSNRFSGSKSGNTASLTISGLQAEDEADYYCCSYAGSSTLGIDWVFGGGTKLTVL

SEQ ID NO: 651 - protein, 115 aa, synthetic construct
LPVLTQPPSASALLGASIKLTCTLSSEHSTYTIEWYQQRPGRSPQYIMKVKSDGSHSKGDGIPDRFMGSSSGADRYLTFSNLQSDDEAEYHCGESHTIDGQVGVVFGGGTKLTVL

SEQ ID NO: 652 - protein, 115 aa, synthetic construct
LPVLTQPPSASALLGASIKLTCTLSSEHSTYTIEWYQQRPGRSPQYIMKVKSDGSHSKGDGIPDRFMGSSSGADRYLTFSNLQSDDEAEYHCGESHTIDGQVGWVFGGGTKLTVL

SEQ ID NO: 653 - protein, 108 aa, synthetic construct; identical to SEQ ID NO: 636

SEQ ID NO: 654 - protein, 108 aa, synthetic construct
SYVLTQPPSVSVPPGKTARITCGGNNVGSKSVHWYQQKPGQAPVLVIYYDTDRPSGIPERFSGSNSGNTATLSISRVEAGDEADYYCQVWDSRSDHVVFGGGTKLTVL

SEQ ID NO: 655 - protein, 108 aa, synthetic construct
SYVLTQPPSVSVAPGKTARITCGGNTFGSKTVHWYQQKPGQAPVLVIYYDSDRPSGIPERFSGSNSGNTATLTISRVEAGDEADYYCQVWDLYSAHVVFGGGTNLTVL

SEQ ID NO: 656 - protein, 108 aa, synthetic construct
SYELTQPPSVSVSPGQTARITCSGDALPKKYAYWYQQKSGQAPVLVIYEDSKRPSGIPERFSGSSSGTMATLTISGAQVEDEADYYCYSTDSSGNHWVFGGGTKLTVL

SEQ ID NO: 657 - protein, 109 aa, synthetic construct
QSALTQPASVSGSPGQSITISCTGTSSDVGGYNYVSWYQQHPGKAPKLMIYEVSNRPSGVSNRFSGSKSGNTASLTISGLQAEDEADYYCSSYTSSSTVFGGGTKLTVL

SEQ ID NO: 658 - protein, 110 aa, synthetic construct
QSALTQPPSASGSPGQSVTISCTGTSSDVGGYNYVSWYQQHPGKAPKLMIYEVIKRPSGVPDRFSGSKSGNTASLTVSGLQAEDEADYYCSAYAGSNNVVFGGGTQLTVL

SEQ ID NO: 659 - protein, 110 aa, synthetic construct
QSVLTQPPSASGTPGQRVTISCSGSSSNIGSNTVNWYQQLPGTAPKLLIYSNNQRPSGVPDRFSGSKSGTSASLAISGLQSEDEADYYCAAWDDSLNGWVFGGGTKLTVL

SEQ ID NO: 660 - protein, 107 aa, synthetic construct
SYELTQPPSVSVSPGQTARITCSADALPKQYAYWYQQKPGQAPVLVIYKDSERPSGIPERFSGSSSGTTVTLTISGVQAEDEADYYCQSADSSATWVFGGGTKLTVL

SEQ ID NO: 661 - protein, 108 aa, synthetic construct
SYELTQPPSVSVSPGQTARITCSGDALPKKYAYWYQQKSGQAPVLVIYEDSKRPSGIPERFSGSSSGTMATLTISGAQVEDEADYYCYSTDSSGNHRVFGGGTKLTVL

SEQ ID NO: 662 - protein, 108 aa, synthetic construct
SYELTQPPSVSVSPGQTARITCSADALPKQYAYWYQQKPGQAPVVVIYKDSERPSGIPERFSGSSSGTTVTLTISGVQAEDEADYYCQSLDSSGTYWVFGGGTKLTVL

SEQ ID NO: 663 - protein, 106 aa, synthetic construct
SYELTQPPSVSVSPGQTASITCSGDKLGDKYACWYQQKPGQSPVLVIYQDSKRPSGIPERFSGSNSGNTATLTISGTQAMDEADYYCQAWDSSTVVFGGGTKLTVL

SEQ ID NO: 664 - protein, 106 aa, synthetic construct; identical to SEQ ID NO: 663

SEQ ID NO: 665 - protein, 106 aa, synthetic construct; identical to SEQ ID NO: 663

SEQ ID NO: 666 - protein, 108 aa, synthetic construct
SSELTQDPAVSVALGQTVRITCQGDSLRSYYASWYQQKPGQAPVLVIYGKNNRPSGIPDRFSGSSSGNTASLTITGAQAEDEADYYCNSRDSSGNHWVFGGGTKLTVL

SEQ ID NO: 667 - protein, 108 aa, synthetic construct
QSALTQPASVSGSPGQSITISCTGTSSDVGGYNYVSWYQQHPGKAPKLMIYDVSKRPSGVSNRFSGSKSGNTASLTISGLQAEDEADYYCCSYAGSVVFGGGTKLTVL

SEQ ID NO: 668 - protein, 108 aa, synthetic construct; identical to SEQ ID NO: 636

SEQ ID NO: 669 - protein, 108 aa, synthetic construct; identical to SEQ ID NO: 666

SEQ ID NO: 670 - protein, 110 aa, synthetic construct
QSVLTQPPSVSEAPRQRVTISCSGSSSNIGNNAVNWYQQLPGKAPKLLIYYDDLLPSGVSDRFSGSKSGTSASLAISGLQSEDEADYYCAAWDDRLNGPVFGGGTKLTVL

SEQ ID NO: 671 - protein, 110 aa, synthetic construct
QSALTQPASVSGSPGQSITISCTGTSSDVGGYNYVSWYQQHPGKAPKLMIYDVSKRPSGVSNRFSGSKSGNTASLTISGLQAEDETDYYCCSYAGSSTLVFGGGTKLTVL

SEQ ID NO: 672 - protein, 104 aa, synthetic construct
SYELTQPPSVSVSPGQTASITCSGDKLGDKHACWYQQKPGQSPMLVIYQDSKRPSGIPERFSGSNSGNTATLTISGTQPMDEADYYCQAWDSSTFGGGTKLTVL

SEQ ID NO: 673 - protein, 106 aa, synthetic construct
SYELTQPSSVSVSPGQTARITCSGDVLAKKYARWFQQKPGQAPVLVIYKDSERPSGIPERFSGSSSGTTVTLTISGAQVEDEADYYCYSAADNNRVFGGGTKLTVL

SEQ ID NO: 674 - protein, 106 aa, synthetic construct; identical to SEQ ID NO: 630

SEQ ID NO: 675 - protein, 106 aa, synthetic construct
SYELTQPSSVSVSPGQTARITCSGDVLAKKYARWFQQKPGQAPVLVIYKDSERPSGIPERFSGSSSGTTVTLTISGAQVEDEADYYCYSAADNNYVFGTGTKVTVL

SEQ ID NO: 676 - protein, 106 aa, synthetic construct; identical to SEQ ID NO: 630

SEQ ID NO: 677 - protein, 108 aa, synthetic construct
SSELTQDPAVSVALGQTVRITCQGDRLRSYYASWYQQKPGQAPVLVIYGKNNRPSGIPDRFSGSSSGNTASLTITGAQAEDEADYHCNSRDSSGNHLVFGGGTKLTVL

SEQ ID NO: 678 - protein, 108 aa, synthetic construct
SSELTQDPAVSVALGQTVRITCQGDSLRSYYASWYQQKPGQAPVLVIYGKNNRPSGIPDRFSGSSSGNTASLTITGAQAEDEADYYCNSRDSSGNHLVFGGGTKLTVL

SEQ ID NO: 679 - protein, 108 aa, synthetic construct
SYVLTQPPSVSVAPGKTARITCGGNNIGSKSVHWYQQKPGQAPVLVIYYDSDRPSGIPERFSGSNSGNTATLTISRVEAGDEADYYCQVWDSSSDHVVFGGGTKLTVL

SEQ ID NO: 680 - protein, 108 aa, synthetic construct; identical to SEQ ID NO: 661

SEQ ID NO: 681 - protein, 109 aa, synthetic construct
QTVVTQEPSLTVSPGGTVTLTCASSTGAVTSGYYPNWFQQKPGQAPRALIYSTSNKHSWTPARFSGSLLGGKAALTLSGVQPEDEAEYYCLLYYGGARVFGGGTKLTVL

SEQ ID NO: 682 - protein, 110 aa, synthetic construct; identical to SEQ ID NO: 633

SEQ ID NO: 683 - protein, 110 aa, synthetic construct
QSALTQPASVSGSPGQSITISCTGTSSDVGGYNYVSWYQQHPGKAPKLMIYDVSKRPSGVSNRFSGSKSGNTASLTISGLQAEDEADYYCCSYAGSSTWVFGGGTKLTVL

SEQ ID NO: 684 - protein, 111 aa, synthetic construct
QSALTQPASVSGSPGQSITISCTGTSSDVGGYNYVSWYQQHPGKAPKLMIYDVSKRPSGVSNRFSGSKSGNTASLTISGLQAEDEADYYCCSYAGSSTFWVFGGGTKLTVL

SEQ ID NO: 685 - protein, 106 aa, synthetic construct; identical to SEQ ID NO: 663

SEQ ID NO: 686 - protein, 107 aa, synthetic construct
SYELTQPPSVSVSPGQTASITCSGDKLGDKYACWYQQRPGQSPVLVIYQDNKRPSGIPERFSGSNSGNTATLTISGTQAMDEADYYCQAWDSSTALVFGGGTKLTVL

SEQ ID NO: 687 - protein, 107 aa, synthetic construct
SYELTQPPSVSVSPGQTASITCSGDKLGDKYACWYQQKPGQSPVLVIYQDSKRPSGIPERFSGSNSGNTATLTISGTQAMDEADYYCQAWDSSTSGVFGGGTKLTVL

SEQ ID NO: 688 - protein, 108 aa, synthetic construct; identical to SEQ ID NO: 666

SEQ ID NO: 689 - protein, 108 aa, synthetic construct; identical to SEQ ID NO: 661

SEQ ID NO: 690 - protein, 108 aa, synthetic construct; identical to SEQ ID NO: 636

SEQ ID NO: 691 - protein, 108 aa, synthetic construct
SYELTQPPSVSVSPGQTARITCSGDALPKKYAYWYQQKSGQAPVLVIYEDSKRPSGIPERFSGSSSGTMATLTISGAQVEDEADYYCYSTDSSGNHAVFGGGTQLTVL

SEQ ID NO: 692 - protein, 108 aa, synthetic construct; identical to SEQ ID NO: 679

SEQ ID NO: 693 - protein, 110 aa, synthetic construct
QSVLTQSPSAFGTPGQRVTISCSGSISNLGSNTVNWYQQLPGTAPKLLIYSNNQRPSGVPDRFSGSKSGTSASLAISGLQFEDEADYHCATWDDSLNGRVFGGGTKLTVL

SEQ ID NO: 694 - protein, 110 aa, synthetic construct; identical to SEQ ID NO: 633

SEQ ID NO: 695 - protein, 110 aa, synthetic construct
QSALTQPPSASGSPGQSVTISCTGTSSDVGGYNYVSWYQQHPGKAPKLMIYEVSKRPSGVPDRFSGSKSGNTASLTVSGLQAEDEADYYCSSYAGSNNWVFGGGTKLTVL

SEQ ID NO: 696 - protein, 110 aa, synthetic construct
QSALTQPASVSGSPGQSITISCTGTSSDVGGYNYVSWYQQHPGKAPKLMIYDVSKRPSGVSNRFSGSKSGNTASLTISGLQAEDEADYYCCSYAGSSTLVFGGGTKLTVL

SEQ ID NO: 697 - protein, 110 aa, synthetic construct; identical to SEQ ID NO: 683

SEQ ID NO: 698 - protein, 111 aa, synthetic construct
QSALTQPPSASGSPGQSVTISCTGTSSDVGGYNYVSWYQQHPGKAPKLMIYEVSKRPSGVPDRFSGSKSGNTASLTVSGLQAEDEADYYCSSYAGSNNFVVFGGGTKLTVL

SEQ ID NO: 699 - protein, 111 aa, synthetic construct
QSVLTQPPSVSGAPGQRVTISCTGSSSNIGAGYDVHWYQQLPGTAPKLLIYGNSNRPSGVPDRFSGSKSGTSASLAITGLQAEDEADYYCQSYDSSLSDVVFGGGTKLTVL

SEQ ID NO: 700 - protein, 111 aa, synthetic construct
QSVLTQPPSVSGAPGQRVTISCTGSSSNIGAGYDVHWYQQLPGTAPKLLIYGNNNRPSGVPDRFSGSKSGTSASLAITGLQAEDEADYYCQSYDSSLSGWVFGGGTKLTVL

SEQ ID NO: 701 - protein, 115 aa, synthetic construct
QAVLTQPASLSASPGASASLTCTLRSGINVGTYRIYWYQQKPGSPPQYLLRYKSDSDKQQGSGVPSRFSGSKDASANAGILLISGLQSEDEADYYCMIWHSSAWVFGGGTKLTVL

SEQ ID NO: 702 - protein, 115 aa, synthetic construct; identical to SEQ ID NO: 701

SEQ ID NO: 703 - protein, 107 aa, synthetic construct
SHELTQPLSVSVALGQSAMITCRGNNIGSQNVHWYHQKPGQAPVLVIYRNINRPSGIPERFSGSTSGTTATLTISRAQAGDEADYYCQVWDSSGSWVFGGGAKLTVL

SEQ ID NO: 704 - protein, 108 aa, synthetic construct; identical to SEQ ID NO: 661

SEQ ID NO: 705 - protein, 108 aa, synthetic construct
SSELTQDPALSVALGQTVRITCQGDSLRSFYASWYQQKPGQAPVLVIYGKSNRPSGIPDRFSGSGSGNTASLTITGAQAEDEADFYCNSRDTSGNYLVFGGGTKLTVL

SEQ ID NO: 706 - protein, 108 aa, synthetic construct; identical to SEQ ID NO: 666

SEQ ID NO: 707 - protein, 108 aa, synthetic construct
SYELTQPPSVSVSPGQTARITCSGDALPKKYAYWYQQKSGQAPVLVIYEDSKRPSGIPERFSGSSSGTMATLTISGAQVEDEADYYCYSTDSSGNHVVFGGGTKLTVL

SEQ ID NO: 708 - protein, 108 aa, synthetic construct; identical to SEQ ID NO: 678

SEQ ID NO: 709 - protein, 108 aa, synthetic construct; identical to SEQ ID NO: 661

SEQ ID NO: 710 - protein, 109 aa, synthetic construct
QTVVTQEPSLTVSPGGTVTLTCASSTGAVTSGYYPNWFQQKPGQTPRALIYSTSNKHSWTPARFSGSLLGGKAALTLSGVQPEDEAEYYCLLYYGGAWVFGGGTKLTVL

SEQ ID NO: 711 - protein, 110 aa, synthetic construct
QSALTQPASVSGSPGQSITISCTGTSSDVGGYNYVSWYQHHPGKAPKLMIYEVSNRPSGVSNRFSGSKSGNTASLTISGLQAEDEADYYCSSYTSSSTWVFGGGTKLTVL

SEQ ID NO: 712 - protein, 110 aa, synthetic construct; identical to SEQ ID NO: 659

SEQ ID NO: 713 - protein, 110 aa, synthetic construct; identical to SEQ ID NO: 695

SEQ ID NO: 714 - protein, 110 aa, synthetic construct; identical to SEQ ID NO: 696

SEQ ID NO: 715 - protein, 110 aa, synthetic construct; identical to SEQ ID NO: 683

SEQ ID NO: 716 - protein, 111 aa, synthetic construct
QSALTQPPSASGSPGQSVTISCTGTSSDVGGYNYVSWYQQHPGKAPKLMIYEVSKRPSGVPDRFSGSKSGNTASLTVSGLQAEDEADYYCSSYAGSNNFEVFGGGTKLTVL

SEQ ID NO: 717 - protein, 115 aa, synthetic construct; identical to SEQ ID NO: 701

SEQ ID NO: 718 - protein, 106 aa, synthetic construct
SYELTQPPSVSVSPGQTASITCSGDKLGDKYACWYQQKPGQSPVVVIYQDSKRPSGIPERFSGSNSGNTATLTISGTQAMDEADYYCQAWDSSTVVFGGGTKLTVL

SEQ ID NO: 719 - protein, 106 aa, synthetic construct
SYELTHPPSVSVSPGQTARITCSADALPKQYAYWYQQKPGQAPVLVIYKDSERPSGIPERFSGSSSGTSVTLTISGVQAEDEADYYCQSANSGTWVFGGGTKLTVL

SEQ ID NO: 720 - protein, 106 aa, synthetic construct
SYELTQPPSVSVSPGQTASITCSGDKLGDKYACWYQQKPGQSPVLVIYQDTKRPSGIPERFSGSNSGNTATLTISGTQAMDEADYYCQAWDSSTVVFGGGTKLTVL

SEQ ID NO: 721 - protein, 107 aa, synthetic construct
SYELTQPPSVSVSPGQTARITCSADALPNQYAYWYQQKPGQAPVLVIYKDSERPSGIPERFSGSSSGTTVTLTISGVQAEDEADYYCQSADSSGTWVFGGGTKLTVL

SEQ ID NO: 722 - protein, 108 aa, synthetic construct; identical to SEQ ID NO: 636

SEQ ID NO: 723 - protein, 108 aa, synthetic construct; identical to SEQ ID NO: 661

SEQ ID NO: 724 - protein, 108 aa, synthetic construct; identical to SEQ ID NO: 678

SEQ ID NO: 725 - protein, 108 aa, synthetic construct; identical to SEQ ID NO: 661

SEQ ID NO: 726 - protein, 108 aa, synthetic construct; identical to SEQ ID NO: 661

SEQ ID NO: 727 - protein, 108 aa, synthetic construct; identical to SEQ ID NO: 661

SEQ ID NO: 728 - protein, 108 aa, synthetic construct
SYVLTQPPSVSVAPGKTARITCGGNNIGSKSVHWYQQTPGQAPVLVIYYDSDRPSGIPDRFSGSNSGNTATLTISRVEAGDEADYYCQVWDSNSDHWVFGGGTKLTVL

SEQ ID NO: 729 - protein, 108 aa, synthetic construct
SYELTQPPSVSVSPGQTARITCSADALPKQYAYWYQQKPGQAPVLVIYKDSERPSGIPERFSGSSSGTTVTLTISGVQAEDEADYYCQSADSSGTYPVFGGGTKLTVL

SEQ ID NO: 730 - protein, 108 aa, synthetic construct; identical to SEQ ID NO: 666

SEQ ID NO: 731 - protein, 109 aa, synthetic construct
QAVVTQEPSLTVSPGGTVTLTCGSSTGAVTSGHYPYWFQQKPGQAPRTLIYDTSNKHSWTPARFSGSLLGGKAALTLSGAQPEDEAEYYCLLSYSGARVFGGGTKLTVL

SEQ ID NO: 732 - protein, 110 aa, synthetic construct; identical to SEQ ID NO: 633

SEQ ID NO: 733 - protein, 110 aa, synthetic construct
QSALTQPASVSGSPGQSITISCTGTSSDVGGYNYVSWYQQHPGKAPKLMIYDVSKRPSGVSNRFSGSKSGNTASLTISGLQAEDEADYYCCSYAGSSTYVFGTGTKVTVL

SEQ ID NO: 734 - protein, 110 aa, synthetic construct
QSALTQPASVSGSPGQSITISCTGTSSDVGGYNYVSWYQQHPGKAPKLMIYEVSNRPSGVSNRFSGSKSGNTASLTISGLQAEDEADYYCSSYTSSSTVVFGGGTKLTVL

SEQ ID NO: 735 - protein, 110 aa, synthetic construct
QSALTQPASVSGSPGQSITISCTGTSSDVGGYNYVSWYQQHPGKAPKLMIYDVSKRPSGVSNRFSGSKSGNTASLTISGLQAEDEADYYCCSYAGSSNVVFGGGTNLTVL

SEQ ID NO: 736 - protein, 111 aa, synthetic construct; identical to SEQ ID NO: 684

SEQ ID NO: 737 - protein, 111 aa, synthetic construct; identical to SEQ ID NO: 698

SEQ ID NO: 738 - protein, 102 aa, synthetic construct
SYELTQPPSVSVSPGQTASITCSGDKLGDKYACWYQQKPGQSPVLVIYQDSKRPSGIPERFSGSNSGNTATLTISGTQAMDEADYYCQATEVFGGGTKLTVL

SEQ ID NO: 739 - protein, 105 aa, synthetic construct
SYELTQPSSVSVSPGQTAKITCSGDVLAKKYARWFQQKPGQVPVLVIYKDSERPSGIPERFSGSSSGATVTLTISGAQVEDEADYYCYSAADNKVFGGGTKLTVL

SEQ ID NO: 740 - protein, 106 aa, synthetic construct
SYELTQPPSVSVSPGQTASITCSGDKLGDKYACWYQQKPGQSPVVVIYQDSKRPSGIPERFSGSNSGNTATLTISGTQAMDEADYYCQAWDSSTAVFGGGTKLTVL

SEQ ID NO: 741 - protein, 106 aa, synthetic construct; identical to SEQ ID NO: 663

SEQ ID NO: 742 - protein, 107 aa, synthetic construct
SYELTQPPSVSVSPGQTARITCSGDALPKKYAYWYQQKSGQAPVLVIYEDSKRPSGIPERFSGSSSGTMATLTISGAQVEDEADYYCYSTDSSGNRVFGGGTKLTVL

SEQ ID NO: 743 - protein, 108 aa, synthetic construct
SYELTQPPSVSVSPGQTARITCSGDALPKKYAYWYQQKSGQAPVLVIYEDSKRPSGIPERFSGSSSGTMATLTISGAQVEDEADYYCYSTDSSGNHRGFGGGTKLTVL

SEQ ID NO: 744 - protein, 108 aa, synthetic construct
QSALTQPRSVSGSPGQSVTISCTGTSSDVGGYNYVSWYQQHPGKAPKLMIYDVSKRPSGVPDRFSGSKSGNTASLTISGLQAEDEADYYCCSYAQGVVFGGGTKLTVL

SEQ ID NO: 745 - protein, 108 aa, synthetic construct
SSELTQDPAVSVALGQTVRITCQGDSLRSYYASWYQQKPGQAPVLLIYGKNNRPSGIPDRFSGSSSGNTASLTITGAQAEDEADYYCNSRDSSGNHWVFGGGTKLTVL

SEQ ID NO: 746 - protein, 108 aa, synthetic construct
SSELTQDPAVSVALGQTVRITCQGDSLRSYYASWYQQKPGQAPVLVIYGKNNRPSGIPDRFSGSSSGNTASLTITGAQAEDEADYYCNSRDSSGNHLVFGTGTKVTVL

SEQ ID NO: 747 - protein, 108 aa, synthetic construct; identical to SEQ ID NO: 666

SEQ ID NO: 748 - protein, 108 aa, synthetic construct
SYVLTQPPSVSVAPGKTARITCGGNNIGSKSVHWYQQKPGQAPVLVIYYDSDRPSGIPERFSGSNSGNTATLTISRVEAGDEADYYCQVWDSSSDHWVFGGGTKLTVL

SEQ ID NO: 749 - protein, 108 aa, synthetic construct; identical to SEQ ID NO: 678

SEQ ID NO: 750 - protein, 108 aa, synthetic construct; identical to SEQ ID NO: 678

SEQ ID NO: 751 - protein, 108 aa, synthetic construct
SSELTQDPAVSVALGQTVRITCQGDSLRSYYASWYQQKPGQAPVLVIYGKNNRPSGIPDRFSGSNSGNTASLTITGAQAEDEADYYCNSRDSSGNHLLFGGGTKLTVL

SEQ ID NO: 752 - protein, 108 aa, synthetic construct
SSELTQDPGVSVALGQTVRITCQGDSLRSYYASWYQQKPGQAPVLVMYGKKNRPSGIPDRFSGSSSGNTASLTITGAQAEDEADYYCKSRDSSGNHVVFGGGTKLTVL

SEQ ID NO: 753 - protein, 108 aa, synthetic construct; identical to SEQ ID NO: 661

SEQ ID NO: 754 - protein, 108 aa, synthetic construct
SSELTQDPAVSVALGQTVRITCQGDSFRNYYASWYQQMPGQAPVLVIYGKNNRPSGIPDRFSGSSSGNTASLTITGAQAEDEADYYCNSRDSSGNHWVFGGGTKLTVL

SEQ ID NO: 755 - protein, 108 aa, synthetic construct; identical to SEQ ID NO: 678

SEQ ID NO: 756 - protein, 108 aa, synthetic construct; identical to SEQ ID NO: 678

SEQ ID NO: 757 - protein, 109 aa, synthetic construct; identical to SEQ ID NO: 681

SEQ ID NO: 758 - protein, 110 aa, synthetic construct
QSALTQPASVSGSPGQSITISCTGTSSDVGVYNFVSWYQQHPGKAPKLMIYDVTKRPSGASERFSGSKSGSTASLTISGLQAEDEADYYCCSYAGSSTWVFGGGTKLTVL

SEQ ID NO: 759 - protein, 111 aa, synthetic construct
QSVLTQPPSVSGAPGQRVTISCTGSSSNIGAGYDVHWYQQLPGTAPKILIYVNNNRPSGVPDRFSGSKSGTSASLAITGLQAEDEADYYCQSYDSSLSGPVFGGGTKLTVL

SEQ ID NO: 760 - protein, 111 aa, synthetic construct
QSALTQPASVSGSPGQSITISCTGTSSDVGGYNYVSWYQQHPGKAPKLMIYDVSKRPSGVSNRFSGSKSGNTASLTISGLQAEDETDYYCCSYAGSSTYWVFGGGTKLTVL

SEQ ID NO: 761 - protein, 112 aa, synthetic construct
QSVLTQPPSVSGAPGQRVTISCTGSSSNIGAGYDVHWYQQLPGTAPKLLIYGNSNRPSGVPDRFSGSKSGTSASLAITGLQAEDEADYYCQSYDSSLSGSYVFGTGTKVTVL

SEQ ID NO: 762 - protein, 115 aa, synthetic construct
QAVLTQPASLSASPGASASLTCTLRSGIHVDTSRIYWYQQKPGSPPQYLLRYKSDSDKHQDSGVPSRFSGSKDASTNAGILLISGLQSEDEADYYCMIWHSSAIVFGGGTKLTVL

SEQ ID NO: 763 - protein, 115 aa, synthetic construct
QAVLTQPASLSASPGASASLTCTLRSGINVGSYRIYWFQQRPGSPPQYLLRYKSDSDKQQGSGVPSRFSGSKDASANAGILLISGLQSEDEADYYCMIWHSSASVFGGGTKVTVL

SEQ ID NO: 764 - protein, 115 aa, synthetic construct; identical to SEQ ID NO: 701

SEQ ID NO: 765 - protein, 108 aa, synthetic construct; identical to SEQ ID NO: 678

SEQ ID NO: 766 - protein, 108 aa, synthetic construct; identical to SEQ ID NO: 678

SEQ ID NO: 767 - protein, 108 aa, synthetic construct
SSELTQDPTVSVALGQTVRITCQGDSLRSYYASWYQQKPGQAPVLVIYGKNNRPSGIPDRFSGSSSGNTASLTITGAQAEDEADYYCNSRDSSGNHWVFGGGTKLTVL

SEQ ID NO: 768 - protein, 108 aa, synthetic construct; identical to SEQ ID NO: 678

SEQ ID NO: 769 - protein, 108 aa, synthetic construct
SSELTPDPAVSVALGQTVRITCQGDSLRSYYASWYQQKPGQAPILVIYHKNNRPSGIPDRFSGSSSGNTASLTITGAQAEDEADYYCNSRDSSGNHVVFGGGTKLTVL

SEQ ID NO: 770 - protein, 108 aa, synthetic construct; identical to SEQ ID NO: 678

SEQ ID NO: 771 - protein, 108 aa, synthetic construct; identical to SEQ ID NO: 661

SEQ ID NO: 772 - protein, 110 aa, synthetic construct
QSALTQPPSASGSPGQSVTISCTGTSSDVGGYNYVSWYQQHPGKAPKLMIYEVSKRPSGVPDRFSGSKSGNTASLTVSGLQAEDEADYYCSSYAGSNNVVFGGGTKLTVL

SEQ ID NO: 773 - protein, 110 aa, synthetic construct; identical to SEQ ID NO: 633

SEQ ID NO: 774 - protein, 110 aa, synthetic construct
QTVVTQEPSLTVSPGGTVTLTCASSTGAVTSGYYPNWFQQKPGQAPRALIYSTSNKHSWTPARFSGSLLGGKAALTLSGVQPEDEAEYYCLLYYGGAQLVFGGGTKLTVL

SEQ ID NO: 775 - protein, 111 aa, synthetic construct
QSVLTQPPSVSGAPGQRVTISCTGSNSNIGAGYDIHWYQQLPVTAPKLLIYGNSNRPSGVPDRFSGSKSGSSASLAITGLQAEDEADYYCQSYDNSLSGSVFGGGTKLTVL

SEQ ID NO: 776 - protein, 106 aa, synthetic construct
SYELTQPSSVSVSPGQTARITCSGDVLAKKFARWFQQKPGQAPLLVIYKDSERPSGIPERFSGSNSGTTVTLTISGAQVEDEADYYCYSAADNNLVFGGGTKLTVL

SEQ ID NO: 777 - protein, 108 aa, synthetic construct; identical to SEQ ID NO: 661

SEQ ID NO: 778 - protein, 108 aa, synthetic construct
SHMLTQPPSVSVAPGTTARITCGGNNFGSKSVHWYQQKPGQAPVLVIYYDSDRPSGIPERFSGSNSGNTATLTISRVEAGDEADYYCQVWDSTSDHYVFGTGTKVTVL

SEQ ID NO: 779 - protein, 110 aa, synthetic construct
QSALTQPASVSGSPGQSITISCTGTSSDVGAYNYVSWYQQHPGKAPKLMIYAVSKRPSGVSYRFSGSKSGNTASLTISGLQAEDEADYYCCSYAGTISWVFGGGTKLTVL

SEQ ID NO: 780 - protein, 110 aa, synthetic construct; identical to SEQ ID NO: 733

SEQ ID NO: 781 - protein, 110 aa, synthetic construct
QSALTQPPSASGSPGQSVTISCTGTSSDVGGYNYVSWYQQHPGKAPKLMIYEVNKRPSGVPDRLSGSKSGNTASLTVSGLQAEDEADYYCSSYAGSNNWVFGGGTKLTVL

SEQ ID NO: 782 - protein, 110 aa, synthetic construct; identical to SEQ ID NO: 683

SEQ ID NO: 783 - protein, 111 aa, synthetic construct
QSVLTQPPSVSGAPGQRVTISCTGSSSNIGAGYDVHWYQQLPGTAPKLLIYGNSNRPSGVPDRFSGSKSGTSASLAITGLQAEDEADYYCQSYDSSLSGWVFGGGTKLTVL

SEQ ID NO: 784 - protein, 111 aa, synthetic construct
QSALTQPPSVSGSPGQSVTISCTGTSSDVGSYNRVSWYQQPPGTAPKLMIYDVSNRPSGVPDRFSGSKSGNTASLTISGLQAEDEADYYCSSYTSSSTYVVFGGGTKLTVL

SEQ ID NO: 785 - protein, 112 aa, synthetic construct
QSILTQPPSVSATPGQRVTISCTGSDSNIGAGYDVHWYQQLPGAVPRLLIHDNIIRPSGVPDRFSGSKSDTSASLAISGLHAEDEADYYCQSYDISLSGSVVFGGGTKLTVL

SEQ ID NO: 786 - protein, 106 aa, synthetic construct
SYELTQPPSVSVSPGQTASITCSGDKLGDKYACWYQQKPGQSPVLVIYQDSKRPSGIPERFSGSNSGNTATLTISGTQAMDEADYYCQAWDSSTAVFGGGTKLTVL

SEQ ID NO: 787 - protein, 106 aa, synthetic construct
SYELTQPPSVSVSPGQTARITCSGDGLSKKYAYWYQQKSGQAPVLVIYEDSKRPSGIPERFSGSSSGTMATLTVSGAQVEDEADYYCYSTDSSGKIFGGGTKLTVL

SEQ ID NO: 788 - protein, 108 aa, synthetic construct; identical to SEQ ID NO: 666

SEQ ID NO: 789 - protein, 108 aa, synthetic construct; identical to SEQ ID NO: 666

SEQ ID NO: 790 - protein, 108 aa, synthetic construct; identical to SEQ ID NO: 661

SEQ ID NO: 791 - protein, 108 aa, synthetic construct; identical to SEQ ID NO: 666

SEQ ID NO: 792 - protein, 108 aa, synthetic construct; identical to SEQ ID NO: 678

SEQ ID NO: 793 - protein, 108 aa, synthetic construct; identical to SEQ ID NO: 666

SEQ ID NO: 794 - protein, 110 aa, synthetic construct; identical to SEQ ID NO: 734

SEQ ID NO: 795 - protein, 110 aa, synthetic construct; identical to SEQ ID NO: 683

SEQ ID NO: 796 - protein, 108 aa, synthetic construct
SSELTQDPAVSVALGQTVRITCQGDSLRSYYATWYQQKPGQAPVLVIYGRNNRPSGIPDRFSGSSSGNTASLTITGAQAEDEADYYCYSRDSSGNHLVFGGGTNLTVL

SEQ ID NO: 797 - protein, 108 aa, synthetic construct
SYVLTQPPSVSVAPGKTARITCGGNNIGSKSVHWYQQKPGQAPVLVIYYDSDRPSGIPERFSGSNSGNTATLTISRVEAGDEADYYCQVWDSSSDHRVFGGGTKLTVL

SEQ ID NO: 798 - protein, 108 aa, synthetic construct; identical to SEQ ID NO: 678

SEQ ID NO: 799 - protein, 108 aa, synthetic construct
SSELTQDPAVSVALGQTVRITCQGDSLRSYYASWYQQKPGQAPVLVFYGKNKRPSGIPDRFSGSSSGNTASLTITGAQAEDEADYYCNSRDSNGNHWVFGGGTKLSVL

SEQ ID NO: 800 - protein, 109 aa, synthetic construct
QSALTQPASVSGSPGQSITISCTGTSSDVGGYNYVSWYQQHPGKAPKLMIYDVSKRPSGVSNRFSGSKSGNTASLTISGLQAEDEADYYCCSYAGSSWVFGGGTKLTVL

SEQ ID NO: 801 - protein, 111 aa, synthetic construct
QPVLTQPPSVSGVPGQRVTISCTGSSSNIGARYDVHWYQQLPGTAPKLLIYGNSNRPSGVPDRFSGSKSGTSASLAITGLQAEDEADYYCQSYDGTLGGWIFGGGTNLTVL

SEQ ID NO: 802 - protein, 108 aa, synthetic construct; identical to SEQ ID NO: 666

SEQ ID NO: 803 - protein, 109 aa, synthetic construct; identical to SEQ ID NO: 800

SEQ ID NO: 804 - protein, 106 aa, synthetic construct
SYELTQPPSVSVSPGQTASITCSGDKLGDKYACWYQQKPGQSPVLVIYQDSKRPSGIPERFSGSNSGNTATLTISGTQAMDEADYYCQAWDSSTVIFGGGTKLTVL

SEQ ID NO: 805 - protein, 108 aa, synthetic construct
SYELTQPPSVSVSPGQTARITCSGDALPKKYAYWYQQKSGQAPVLVIYEDNKRPSGIPERFSGSSSGTMATLTISGAQVEDEADYYCYSTDSSGNHRVFGGGTKLTVL

SEQ ID NO: 806 - protein, 108 aa, synthetic construct
SSELTQDPAVSVALGQTVRITCQGDSLRNYYASWYQQKPGQAPVIVIYGKNNRPSGIPDRFSGSSSGNTASLTITGAQAEDEADYYCNSRDSSGNHLVFGGGTKLTVL

SEQ ID NO: 807 - protein, 108 aa, synthetic construct
QSALTQPPSASGSPGQSVTISCTGTSSDVGGYNYVSWYQQHPGKAPKLMIYEVSKRPSGVPDRFSGSKSGNTASLTVSGLQAEDEADYYCSSYAGSNNFGGGTKLTVL

SEQ ID NO: 808 - protein, 108 aa, synthetic construct
SSELTQDPAVSVALGQTVRITCQGDSLRTYYASWYQQKPGQAPVLVIYGKNKRPSGIPDRFSGSSSGNTASLTITGAQAEDEADYYCNSRDSSGNHWVFGGGTKLTVL

SEQ ID NO: 809 - protein, 108 aa, synthetic construct
SYVLTQPPSVSVAPGQTARIICGGDNIGIKNVHWYQQKPGQAPVLVIYDDSDRPSGIPERFSGSNSGNTATLTISRVEAGDEADYCCQVWDSSSDHVVFGGGTKLTVL

SEQ ID NO: 810 - protein, 106 aa, synthetic construct
SYELTQPPSVSVSPGQTASITCSGDKLGDKYTCWYQQKPGQSPVLVIYQDIKRPSGIPDRFSGSNSGNTATLTISGTQAMDEADYYCQAWDSSTVVFGGGTKLTVL

SEQ ID NO: 811 - protein, 108 aa, synthetic construct; identical to SEQ ID NO: 636

SEQ ID NO: 812 - protein, 110 aa, synthetic construct; identical to SEQ ID NO: 695

SEQ ID NO: 813 - protein, 110 aa, synthetic construct; identical to SEQ ID NO: 641

SEQ ID NO: 814 - protein, 109 aa, synthetic construct; identical to SEQ ID NO: 731

SEQ ID NO: 815 - protein, 12 aa, synthetic construct
CASLTGDRFDYW

SEQ ID NO: 816 - protein, 15 aa, synthetic construct
CTGRPSIAARHFDYW

SEQ ID NO: 817 - protein, 19 aa, synthetic construct
CARERLTIFGVVNYYMDVW

SEQ ID NO: 818 - protein, 9 aa, synthetic construct
CARDGWDYW

SEQ ID NO: 819 - protein, 16 aa, synthetic construct
CARGYSGSYYGDFDYW

SEQ ID NO: 820 - protein, 14 aa, synthetic construct
CAKKPPRDSAFDYW

SEQ ID NO: 821 - protein, 15 aa, synthetic construct
CARENSGSYYWFDPW

SEQ ID NO: 822 - protein, 12 aa, synthetic construct
CAKLEYSSPDYW

SEQ ID NO: 823 - protein, 18 aa, synthetic construct
CAREGLLVGATLDAFDIW

SEQ ID NO: 824 - protein, 17 aa, synthetic construct
CARDTGITMVRGVFDYW

SEQ ID NO: 825 - protein, 20 aa, synthetic construct
CARDRTGISAAGPSNWFDPW

SEQ ID NO: 826 - protein, 14 aa, synthetic construct
CARTSLAAADFDYW

SEQ ID NO: 827 - protein, 17 aa, synthetic construct
CARAPDYYGSGSLFDYW

SEQ ID NO: 828 - protein, 11 aa, synthetic construct
CASHWGHFDYW

SEQ ID NO: 829 - protein, 10 aa, synthetic construct
CARDRTLDYW

SEQ ID NO: 830 - protein, 9 aa, synthetic construct
CARQIGDYW

SEQ ID NO: 831 - protein, 8 aa, synthetic construct
CTGPFDNW

SEQ ID NO: 832 - protein, 8 aa, synthetic construct [sequence omitted]

SEQ ID NO: 833 - protein, 10 aa, synthetic construct
CAKARSFDIW

SEQ ID NO: 834 - protein, 8 aa, synthetic construct
CRADMDVW

SEQ ID NO: 835 - protein, 10 aa, synthetic construct [sequence omitted]

SEQ ID NO: 836 - protein, 11 aa, synthetic construct [sequence omitted]

SEQ ID NO: 837 - protein, 10 aa, synthetic construct
CARGASFDFW

SEQ ID NO: 838 - protein, 8 aa, synthetic construct
CTGPFDYW

SEQ ID NO: 839 - protein, 11 aa, synthetic construct
CARSFDAFDIW

SEQ ID NO: 840 - protein, 11 aa, synthetic construct
CAGLTGELDYW

SEQ ID NO: 841 - protein, 12 aa, synthetic construct
CARWGTGGFDYW

SEQ ID NO: 842 - protein, 11 aa, synthetic construct
CARREGFFDYW

SEQ ID NO: 843 - protein, 11 aa, synthetic construct
CARDQLAPDYW

SEQ ID NO: 844 - protein, 11 aa, synthetic construct
CAKDSSGFDYW

SEQ ID NO: 845 - protein, 11 aa, synthetic construct
CAKDPQFFDYW

SEQ ID NO: 846 - protein, 11 aa, synthetic construct
CAKDGTAFDIW

SEQ ID NO: 847 - protein, 12 aa, synthetic construct
CARDRGWGLDYW

SEQ ID NO: 848 - protein, 12 aa, synthetic construct
CARGELGDFDYW

SEQ ID NO: 849 - protein, 12 aa, synthetic construct
CARVLELYFDYW

SEQ ID NO: 850 - protein, 10 aa, synthetic construct
CTTRSDFQHW

SEQ ID NO: 851 - protein, 13 aa, synthetic construct
CARDQELRVFDYW

SEQ ID NO: 852 - protein, 13 aa, synthetic construct
CAKASGYGPFDYW

SEQ ID NO: 853 - protein, 13 aa, synthetic construct
CARHSSSSHFDYW

SEQ ID NO: 854 - protein, 13 aa, synthetic construct
CARDRGNSLFDYW

SEQ ID NO: 855 - protein, 13 aa, synthetic construct
CARDKSLEWFDYW

SEQ ID NO: 856 - protein, 14 aa, synthetic construct
CARGDWNYGGFDYW

SEQ ID NO: 857 - protein, 11 aa, synthetic construct
CTTAPDAFDIW

SEQ ID NO: 858 - protein, 13 aa, synthetic construct
CASGITGTTGDYW

SEQ ID NO: 859 - protein, 13 aa, synthetic construct
CAKEGAHDAFDIW

SEQ ID NO: 860 - protein, 13 aa, synthetic construct
CAKDKGELPFDYW

SEQ ID NO: 861 - protein, 13 aa, synthetic construct
CAKLGVRDYMDVW

SEQ ID NO: 862 - protein, 13 aa, synthetic construct
CAREGGGWVFDYW

SEQ ID NO: 863 - protein, 13 aa, synthetic construct
CARGGGGDPFDYW

SEQ ID NO: 864 - protein, 13 aa, synthetic construct
CARPYNWNSFDYW

SEQ ID NO: 865 - protein, 13 aa, synthetic construct
CAKDNDWNGFDYW

SEQ ID NO: 866 - protein, 13 aa, synthetic construct
CAKDNWNYAFDIW

SEQ ID NO: 867 - protein, 13 aa, synthetic construct
CARDLDWTLFDYW

SEQ ID NO: 868 - protein, 14 aa, synthetic construct
CAGDYSNYGWFDPW

SEQ ID NO: 869 - protein, 14 aa, synthetic construct
CARARDSGYYMDVW

SEQ ID NO: 870 - protein, 14 aa, synthetic construct
CARATAMVTGIDYW

SEQ ID NO: 871 - protein, 12 aa, synthetic construct
CTGSSGSYFDYW

SEQ ID NO: 872 - protein, 14 aa, synthetic construct
CARSPYNWNYVDYW

SEQ ID NO: 873 - protein, 14 aa, synthetic construct
CATEGPSTFSFDYW

SEQ ID NO: 874 - protein, 14 aa, synthetic construct
CATANWNDEAFDIW

SEQ ID NO: 875 - protein, 14 aa, synthetic construct
CARDELTGDAFDIW

SEQ ID NO: 876 - protein, 12 aa, synthetic construct
CTTEALGIFDYW

SEQ ID NO: 877 - protein, 14 aa, synthetic construct
CARDGSSGFLFDYW

SEQ ID NO: 878 - protein, 14 aa, synthetic construct
CAKHYYDSRSFDYW

SEQ ID NO: 879 - protein, 14 aa, synthetic construct
CARDFQGTGPFDYW

SEQ ID NO: 880 - protein, 16 aa, synthetic construct
CARGRLYSGSFSFDYW

SEQ ID NO: 881 - protein, 15 aa, synthetic construct
CARDGGYNWNFFDYW

SEQ ID NO: 882 - protein, 14 aa, synthetic construct
CTHRDAAMVYFDYW

SEQ ID NO: 883 - protein, 15 aa, synthetic construct [sequence omitted]

SEQ ID NO: 884 - protein, 16 aa, synthetic construct
CARGWNYGSGSCFDNW

SEQ ID NO: 885 - protein, 16 aa, synthetic construct
CARGFSGTYYGDFDYW

SEQ ID NO: 886 - protein, 15 aa, synthetic construct
CAREGEWEPLHMDVW

SEQ ID NO: 887 - protein, 15 aa, synthetic construct
CAKSLSGSYVYMDVW

SEQ ID NO: 888 - protein, 15 aa, synthetic construct
CAKGFLEWLLGFDYW

SEQ ID NO: 889 - protein, 15 aa, synthetic construct
CARDGGSSGYYSDYW

SEQ ID NO: 890 - protein, 15 aa, synthetic construct
CTRDLVYSSGWYDYW

SEQ ID NO: 891 - protein, 15 aa, synthetic construct
CAREGIKASDAFDIW

SEQ ID NO: 892 - protein, 15 aa, synthetic construct
CAKDIDPSITGTDYW

SEQ ID NO: 893 - protein, 15 aa, synthetic construct
CAGLRHFDWLGFDSW

SEQ ID NO: 894 - protein, 15 aa, synthetic construct
CAKEDNWNYGWFDPW

SEQ ID NO: 895 - protein, 16 aa, synthetic construct
CAREETGTTSWYFDLW

SEQ ID NO: 896 - protein, 15 aa, synthetic construct [sequence omitted]

SEQ ID NO: 897 - protein, 16 aa, synthetic construct
CATPYCSGGSCHFDYW

SEQ ID NO: 898 - protein, 16 aa, synthetic construct
CARDDYGGNSVYFDYW

SEQ ID NO: 899 - protein, 16 aa, synthetic construct
CVRAARYSGTYIFDYW

SEQ ID NO: 900 - protein, 14 aa, synthetic construct
CTTDPGYSYGVDYW

SEQ ID NO: 901 - protein, 16 aa, synthetic construct
CARPEYSSSSGYFQHW

SEQ ID NO: 902 - protein, 16 aa, synthetic construct
CAREYNWNYEDAFDIW

SEQ ID NO: 903 - protein, 15 aa, synthetic construct
CAHRRGSYSNWFDPW

SEQ ID NO: 904 - protein, 16 aa, synthetic construct
CARTLFGVVKNWFDPW

SEQ ID NO: 905 - protein, 16 aa, synthetic construct
CAREVLGGGDCPFDYW

SEQ ID NO: 906 - protein, 16 aa, synthetic construct
CARSDGGSHYVFFDDW

SEQ ID NO: 907 - protein, 16 aa, synthetic construct
CAKDIAYSSSGHFDYW

SEQ ID NO: 908 - protein, 16 aa, synthetic construct
CARAPLTGTTNWFDPW

SEQ ID NO: 909 - protein, 17 aa, synthetic construct
CAGVLYYDSSGYPFDYW

SEQ ID NO: 910 - protein, 17 aa, synthetic construct
CARDPLAARPVGWFDPW

SEQ ID NO: 911 - protein, 17 aa, synthetic construct
CAREDGYSSGWNYFDYW

SEQ ID NO: 912 - protein, 17 aa, synthetic construct
CATGGQTIVAARVFDYW

SEQ ID NO: 913 - protein, 17 aa, synthetic construct
CARDQTPSDHYYYMDVW

SEQ ID NO: 914 - protein, 17 aa, synthetic construct
CARDRGITMRLDNMDVW

SEQ ID NO: 915 - protein, 15 aa, synthetic construct
CTRRYNWNDVGFDYW

SEQ ID NO: 916 - protein, 17 aa, synthetic construct
CAHRPGITGNTGYFDYW

SEQ ID NO: 917 - protein, 18 aa, synthetic construct
CARCRYSGSLTSYYMDVW

SEQ ID NO: 918 - protein, 18 aa, synthetic construct
CAKDMITGTTNYYYMDVW

SEQ ID NO: 919 - protein, 18 aa, synthetic construct
CAKGGYDFWSGYYPFDPW

SEQ ID NO: 920 - protein, 16 aa, synthetic construct
CTTEGTTVTTWAFDIW

SEQ ID NO: 921 - protein, 14 aa, synthetic construct
CASSGSYSDAFDIW

SEQ ID NO: 922 - protein, 18 aa, synthetic construct
CAKDRTGYYHYYYFMDVW

SEQ ID NO: 923 - protein, 18 aa, synthetic construct
CARSGYNWKYDYYYMDVW

SEQ ID NO: 924 - protein, 19 aa, synthetic construct
CAREGGYDFWSGLNWFDPW

SEQ ID NO: 925 - protein, 19 aa, synthetic construct
CARAGGIAAAGTGYWFDPW

SEQ ID NO: 926 - protein, 17 aa, synthetic construct
CTTADYDFWSGYYMDVW

SEQ ID NO: 927 - protein, 15 aa, synthetic construct
CARDLELRGGAFDIW

SEQ ID NO: 928 - protein, 20 aa, synthetic construct
CTRGEGATWGNYHCYYMDVW

SEQ ID NO: 929 - protein, 20 aa, synthetic construct
CARDQITMVRGFLGDWFDPW

SEQ ID NO: 930 - protein, 12 aa, synthetic construct [sequence omitted]

SEQ ID NO: 931 - protein, 16 aa, synthetic construct
CAREEIVGATTAFDIW

SEQ ID NO: 932 - protein, 16 aa, synthetic construct
CARDYGGNSGWYFDLW

SEQ ID NO: 933 - protein, 14 aa, synthetic construct
CAREGLTGHVFDIW

SEQ ID NO: 934 - protein, 16 aa, synthetic construct
CARGGGSGSYDWFDPW

SEQ ID NO: 935 - protein, 21 aa, synthetic construct
CAREGVLCSGGSCYREIFDYW

SEQ ID NO: 936 - protein, 20 aa, synthetic construct
CSTSPYYDFWSGYYGYIDYW

SEQ ID NO: 937 - protein, 20 aa, synthetic construct
CSTSPYFDFWSGYYGYLDYW

SEQ ID NO: 938 - protein, 14 aa, synthetic construct
CARHAAAGGWFDPW

SEQ ID NO: 939 - protein, 15 aa, synthetic construct
CARRSSSGIGAFDIW

SEQ ID NO: 940 - protein, 17 aa, synthetic construct
CARGRGIAARPPYFDYW

SEQ ID NO: 941 - protein, 16 aa, synthetic construct
CASEYSSSSLDAFDIW

SEQ ID NO: 942 - protein, 19 aa, synthetic construct
CARGTTVVTPTEYYYMDVW

SEQ ID NO: 943 - protein, 26 aa, synthetic construct
CARRGDFWSGYYSTSQNIVIHWFDSW

SEQ ID NO: 944 - protein, 12 aa, synthetic construct [sequence omitted]

SEQ ID NO: 945 - protein, 13 aa, synthetic construct [sequence omitted]

SEQ ID NO: 946 - protein, 13 aa, synthetic construct [sequence omitted]

SEQ ID NO: 947 - protein, 11 aa, synthetic construct [sequence omitted]

SEQ ID NO: 948 - protein, 12 aa, synthetic construct [sequence omitted]

SEQ ID NO: 949 - protein, 13 aa, synthetic construct [sequence omitted]

SEQ ID NO: 950 - protein, 12 aa, synthetic construct [sequence omitted]

SEQ ID NO: 951 - protein, 12 aa, synthetic construct [sequence omitted]

SEQ ID NO: 952 - protein, 13 aa, synthetic construct [sequence omitted]

SEQ ID NO: 953 - protein, 13 aa, synthetic construct [sequence omitted]

SEQ ID NO: 954 - protein, 13 aa, synthetic construct [sequence omitted]

SEQ ID NO: 955 - protein, 12 aa, synthetic construct [sequence omitted]

SEQ ID NO: 956 - protein, 13 aa, synthetic construct [sequence omitted]

SEQ ID NO: 957 - protein, 11 aa, synthetic construct [sequence omitted]

SEQ ID NO: 958 - protein, 13 aa, synthetic construct [sequence omitted]

SEQ ID NO: 959 - protein, 12 aa, synthetic construct
CSAYAGSNNVVF

SEQ ID NO: 960 - protein, 11 aa, synthetic construct [sequence omitted]

SEQ ID NO: 961 - protein, 12 aa, synthetic construct [sequence omitted]

SEQ ID NO: 962 - protein, 13 aa, synthetic construct [sequence omitted]

SEQ ID NO: 963 - protein, 13 aa, synthetic construct [sequence omitted]

SEQ ID NO: 964 - protein, 13 aa, synthetic construct [sequence omitted]

SEQ ID NO: 965 - protein, 13 aa, synthetic construct [sequence omitted]

SEQ ID NO: 966 - protein, 12 aa, synthetic construct
CSSYTRSSTCVF

SEQ ID NO: 967 - protein, 12 aa, synthetic construct [sequence omitted]

SEQ ID NO: 968 - protein, 13 aa, synthetic construct [sequence omitted]

SEQ ID NO: 969 - protein, 11 aa, synthetic construct [sequence omitted]

SEQ ID NO: 970 - protein, 12 aa, synthetic construct [sequence omitted]

SEQ ID NO: 971 - protein, 13 aa, synthetic construct [sequence omitted]

SEQ ID NO: 972 - protein, 13 aa, synthetic construct [sequence omitted]

SEQ ID NO: 973 - protein, 13 aa, synthetic construct [sequence omitted]

SEQ ID NO: 974 - protein, 13 aa, synthetic construct [sequence omitted]

SEQ ID NO: 975 - protein, 13 aa, synthetic construct [sequence omitted]

SEQ ID NO: 976 - protein, 11 aa, synthetic construct [sequence omitted]

SEQ ID NO: 977 - protein, 13 aa, synthetic construct [sequence omitted]

SEQ ID NO: 978 - protein, 11 aa, synthetic construct [sequence omitted]

SEQ ID NO: 979 - protein, 13 aa, synthetic construct [sequence omitted]

SEQ ID NO: 980 - protein, 11 aa, synthetic construct [sequence omitted]

SEQ ID NO: 981 - protein, 11 aa, synthetic construct [sequence omitted]

SEQ ID NO: 982 - protein, 11 aa, synthetic construct [sequence omitted]

SEQ ID NO: 983 - protein, 13 aa, synthetic construct [sequence omitted]

SEQ ID NO: 984 - protein, 13 aa, synthetic construct [sequence omitted]

SEQ ID NO: 985 - protein, 13 aa, synthetic construct [sequence omitted]

SEQ ID NO: 986 - protein, 13 aa, synthetic construct [sequence omitted]

SEQ ID NO: 987 - protein, 13 aa, synthetic construct [sequence omitted]

SEQ ID NO: 988 - protein, 13 aa, synthetic construct [sequence omitted]

SEQ ID NO: 989 - protein, 13 aa, synthetic construct [sequence omitted]

SEQ ID NO: 990 - protein, 13 aa, synthetic construct [sequence omitted]

SEQ ID NO: 991 - protein, 13 aa, synthetic construct [sequence omitted]

SEQ ID NO: 992 - protein, 13 aa, synthetic construct [sequence omitted]

SEQ ID NO: 993 - protein, 12 aa, synthetic construct [sequence omitted]

SEQ ID NO: 994 - protein, 12 aa, synthetic construct
CNSYTTNTTRVF

SEQ ID NO: 995 - protein, 12 aa, synthetic construct [sequence omitted]

SEQ ID NO: 996 - protein, 11 aa, synthetic construct [sequence omitted]

SEQ ID NO: 997 - protein, 10 aa, synthetic construct [sequence omitted]

SEQ ID NO: 998 - protein, 11 aa, synthetic construct [sequence omitted]

SEQ ID NO: 999 - protein, 11 aa, synthetic construct [sequence omitted]

SEQ ID NO: 1000 - protein, 11 aa, synthetic construct [sequence omitted]

SEQ ID NO: 1001 - protein, 13 aa, synthetic construct [sequence omitted]

SEQ ID NO: 1002 - protein, 13 aa, synthetic construct [sequence omitted]

SEQ ID NO: 1003 - protein, 13 aa, synthetic construct [sequence omitted]

SEQ ID NO: 1004 - protein, 13 aa, synthetic construct [sequence omitted]

SEQ ID NO: 1005 - protein, 13 aa, synthetic construct [sequence omitted]

SEQ ID NO: 1006 - protein, 11 aa, synthetic construct [sequence omitted]

SEQ ID NO: 1007 - protein, 12 aa, synthetic construct [sequence omitted]

SEQ ID NO: 1008 - protein, 13 aa, synthetic construct
CQSYDGSLNGWVF

SEQ ID NO: 1009 - protein, 13 aa, synthetic construct
CKSRDRSGNHWVF

SEQ ID NO: 1010 - protein, 13 aa, synthetic construct [sequence omitted]

SEQ ID NO: 1011 - protein, 13 aa, synthetic construct [sequence omitted]

SEQ ID NO: 1012 - protein, 13 aa, synthetic construct [sequence omitted]

SEQ ID NO: 1013 - protein, 13 aa, synthetic construct
CNSRDISGKHWVF

SEQ ID NO: 1014 - protein, 13 aa, synthetic construct [sequence omitted]

SEQ ID NO: 1015 - protein, 13 aa, synthetic construct [sequence omitted]

SEQ ID NO: 1016 - protein, 13 aa, synthetic construct [sequence omitted]

SEQ ID NO: 1017 - protein, 13 aa, synthetic construct [sequence omitted]

SEQ ID NO: 1018 - protein, 13 aa, synthetic construct [sequence omitted]

SEQ ID NO: 1019 - protein, 13 aa, synthetic construct [sequence omitted]

SEQ ID NO: 1020 - protein, 13 aa, synthetic construct [sequence omitted]

SEQ ID NO: 1021 - protein, 14 aa, synthetic construct [sequence omitted]

SEQ ID NO: 1022 - protein, 11 aa, synthetic construct [sequence omitted]

SEQ ID NO: 1023 - protein, 12 aa, synthetic construct [sequence omitted]

SEQ ID NO: 1024 - protein, 13 aa, synthetic construct [sequence omitted]

SEQ ID NO: 1025 - protein, 13 aa, synthetic construct [sequence omitted]

SEQ ID NO: 1026 - protein, 11 aa, synthetic construct [sequence omitted]

SEQ ID NO: 1027 - protein, 13 aa, synthetic construct [sequence omitted]

SEQ ID NO: 1028 - protein, 13 aa, synthetic construct
CQVWDSSSYHYVF

SEQ ID NO: 1029 - protein, 13 aa, synthetic construct [sequence omitted]

SEQ ID NO: 1030 - protein, 13 aa, synthetic construct [sequence omitted]

SEQ ID NO: 1031 - protein, 11 aa, synthetic construct [sequence omitted]

SEQ ID NO: 1032 - protein, 12 aa, synthetic construct [sequence omitted]

SEQ ID NO: 1033 - protein, 13 aa, synthetic construct
CAAWDGRLNEWVF

SEQ ID NO: 1034 - protein, 13 aa, synthetic construct [sequence omitted]

SEQ ID NO: 1035 - protein, 13 aa, synthetic construct
CTAWDDRLNGPVF

SEQ ID NO: 1036 - protein, 12 aa, synthetic construct [sequence omitted]

SEQ ID NO: 1037 - protein, 13 aa, synthetic construct [sequence omitted]

SEQ ID NO: 1038 - protein, 11 aa, synthetic construct [sequence omitted]

SEQ ID NO: 1039 - protein, 11 aa, synthetic construct [sequence omitted]

SEQ ID NO: 1040 - protein, 13 aa, synthetic construct [sequence omitted]

SEQ ID NO: 1041 - protein, 13 aa, synthetic construct [sequence omitted]

SEQ ID NO: 1042 - protein, 13 aa, synthetic construct [sequence omitted]

SEQ ID NO: 1043 - protein, 13 aa, synthetic construct [sequence omitted]

SEQ ID NO: 1044 - protein, 12 aa, synthetic construct [sequence omitted]

SEQ ID NO: 1045 - protein, 11 aa, synthetic construct [sequence omitted]

SEQ ID NO: 1046 - protein, 11 aa, synthetic construct [sequence omitted]

SEQ ID NO: 1047 - protein, 11 aa, synthetic construct [sequence omitted]

SEQ ID NO: 1048 - protein, 12 aa, synthetic construct
CQVWDNNTPWVF

SEQ ID NO: 1049 - protein, 13 aa, synthetic construct [sequence omitted]

SEQ ID NO: 1050 - protein, 13 aa, synthetic construct [sequence omitted]

SEQ ID NO: 1051 - protein, 13 aa, synthetic construct [sequence omitted]

SEQ ID NO: 1052 - protein, 14 aa, synthetic construct [sequence omitted]

SEQ ID NO: 1053 - protein, 13 aa, synthetic construct [sequence omitted]

SEQ ID NO: 1054 - protein, 13 aa, synthetic construct [sequence omitted]

SEQ ID NO: 1055 - protein, 13 aa, synthetic construct [sequence omitted]

SEQ ID NO: 1056 - protein, 13 aa, synthetic construct [sequence omitted]

SEQ ID NO: 1057 - protein, 13 aa, synthetic construct [sequence omitted]

SEQ ID NO: 1058 - protein, 13 aa, synthetic construct [sequence omitted]

SEQ ID NO: 1059 - protein, 13 aa, synthetic construct [sequence omitted]

SEQ ID NO: 1060 - protein, 13 aa, synthetic construct [sequence omitted]

SEQ ID NO: 1061 - protein, 13 aa, synthetic construct [sequence omitted]

SEQ ID NO: 1062 - protein, 12 aa, synthetic construct [sequence omitted]

SEQ ID NO: 1063 - protein, 12 aa, synthetic construct [sequence omitted]

SEQ ID NO: 1064 - protein, 13 aa, synthetic construct [sequence omitted]

SEQ ID NO: 1065 - protein, 13 aa, synthetic construct
CQSFDSSLSGVMF

SEQ ID NO: 1066 - protein, 13 aa, synthetic construct [sequence omitted]

SEQ ID NO: 1067 - protein, 11 aa, synthetic construct [sequence omitted]

SEQ ID NO: 1068 - protein, 11 aa, synthetic construct [sequence omitted]

SEQ ID NO: 1069 - protein, 13 aa, synthetic construct [sequence omitted]

SEQ ID NO: 1070 - protein, 13 aa, synthetic construct [sequence omitted]

SEQ ID NO: 1071 - protein, 11 aa, synthetic construct [sequence omitted]

SEQ ID NO: 1072 - protein, 13 aa, synthetic construct [sequence omitted]

SEQ ID NO: 1073 - protein, 118 aa, synthetic construct
QLQLQESGPGLVKPSETLSLTCTVSGGSISSSSYYWGWIRQPPGKGLEWIGSIYYSGSTYYNPSLKSRVTISVDTSKNQFSLKLSSVTAADTAVYYCASLTGDRFDYWGQGTLVTVSS

SEQ ID NO: 1074 - protein, 122 aa, synthetic construct
EVQLVESGGGLVKPGGSLRLSCAASGFTFSNAWMSWVRQAPGKGLEWVGRIKSKTDGGTTDYAAPVKGRFTISRDDSKNTLYLQMNSLKTEDTAVYYCTGRPSIAARHFDYWGQGTLVTVSS

SEQ ID NO: 1075 - protein, 124 aa, synthetic construct
EVQLVESGGGVVRPGGSLRLSCAASGFTFDDYGMSWVRQAPGKGLEWVSGINWNGGSTGYADSVKGRFTISRDNAKNSLYLQMNSLRAEDTALYYCARERLTIFGVVNYYMDVWGKGTTVTVSS

SEQ ID NO: 1076 - protein, 114 aa, synthetic construct
EVQLVESGGGLVQPGGSLRLSCAASGFTFSSYSMNWVRQAPGKGLEWVSYISSSSSTIYYADSVKGRFTISRDNAKNSLYLQMNSLRDEDTAVYYCARDGWDYWGQGTLVTVSS

SEQ ID NO: 1077 - protein, 120 aa, synthetic construct
EVQLVESGGGLVQPGGSLKLSCAASGFTFSSSDMHWVRQTTGKGLEWVSAIYTTGDTYYPGSVKGRFTISRENAKNSLYLQMNSLRAGDTAVYYCARGYSGSYYGDFDYWGQGTLVTVSS

SEQ ID NO: 1078 - protein, 119 aa, synthetic construct
EVQLVESGGGLVQPGGSLRLSCAASGFTFSSYAMSWVRQAPGKGLEWVSAISGSGGSTYYADSVKGRFTISRDNSKNTLYLQMNSLRAEDTAVYYCAKKPPRDSAFDYWGQGTLVTVSS

SEQ ID NO: 1079 - protein, 120 aa, synthetic construct
QVQLVQSGAEVKKPGASVKVSCKASGYTFTSYGISWVRQAPGQGLEWMGWISAYNGNTNYAQKLQGRVTMTTDTSTSTAYMELRSLRSDDTAVYYCARENSGSYYWFDPWGQGTLVTVSS

SEQ ID NO: 1080 - protein, 117 aa, synthetic construct
EVQLVESGGGLVQPGGSLRLSCAASGFTFSSYAMSWVRQAPGKGLEWVSAISGSGGSTYYADSVKGRFTISRDNSKNTLYLQMNSLRAEDTAVYYCAKLEYSSPDYWGQGTLVTVSS

SEQ ID NO: 1081 - protein, 122 aa, synthetic construct
QVQLQQWGAGLLKPSETLSLTCAVYGGSFSGYYWSWIRQPPGKGLEWIGEINHSGSTNYNPSLKSRVTISVDTSKNQFSLKLSSVTAADTAVYYCAREGLLVGATLDAFDIWGQGTMVTVSS

SEQ ID NO: 1082 - protein, 122 aa, synthetic construct; identical to SEQ ID NO: 449

SEQ ID NO: 1083 - protein, 125 aa, synthetic construct
QVQLVQSGAEVKKPGASVKVSCKASGYTFTSYGISWVRQAPGQGLEWMGWISAYNGNTNYAQKFQGRVTMTTDTSTNTAYMELRSLRSDDKAVFYCARDRTGISAAGPSNWFDPWGQGTLVTVSS

SEQ ID NO: 1084 - protein, 118 aa, synthetic construct
QVQLQQWGAGLLKPSETLSLTCAVYGGSFSGYYWSWIRQPPGKGLEWIGEINHSGSTNYNPSLKSRVTISVDTSKNQFSLKLSSVTAADTAVYYCARTSLAAADFDYWGQGTLVTVSS

SEQ ID NO: 1085 - protein, 121 aa, synthetic construct
EVQLVESGGGLIQPGGSLRLSCAASGFTVSSNYMSWVRQAPGKGLEWVSVIYSGGSTYYADSVKGRFTISRDNSKNTLYLQMNSLRAEDTAVYYCARAPDYYGSGSLFDYWGQGTLVTVSS

SEQ ID NO: 1086 - protein, 116 aa, synthetic construct
EVQLVESGGGLVKPGGSLRLSCIASGFTFSTYSMNWVRQAPGKGLEWVSSISGSSSYIYYSDSVKGRFTISRDNAKNSLYLQLNSLRAEDTAVYYCASHWGHFDYWGRGTLVTVSS

SEQ ID NO: 1087 - protein, 114 aa, synthetic construct
EVQLVESGGGLVQPGGSLRLSCAASGFTFSSYDMHWVRQATGKGLEWVSAIGTAGDTYYPGSVKGRFTISRENAKNSLYLQMNSLRAGDTAVYYCARDRTLDYWGQGTLVTVSS

SEQ ID NO: 1088 - protein, 114 aa, synthetic construct; identical to SEQ ID NO: 470

SEQ ID NO: 1089 - protein, 115 aa, synthetic construct
EVQLVESGGGLVQTGGSLKLSCAASGFTFSVSPIHWVRQASGKGLEWVGRIRSKANSYATAYGASVKGRFTISRDDSKNTAYLQMNSLKTEDTAVYYCTGPFDNWGQGTLVTVSS

SEQ ID NO: 1090 - protein, 115 aa, synthetic construct
EVQLVESGGGLVKPGGSLRLSCAASGFTFSNAWMSWVRQAPGKGLEWVGRIKSKTDGGTTDYTAPVKGRFTISRDDSKNTLYLQMNSLRTEDTAVYYCTTGGHYWGQGTLVTVSS

SEQ ID NO: 1091 - protein, 115 aa, synthetic construct
EVQLVESGGGLVQPGRSLRLSCAASGFTFDDYAMHWVRQAPGKGLEWVSGISWNSGSIGYADSVKGRFTISRDNAKNSLYLQMNSLRAEDTALYYCAKARSFDIWGQGTMVTVSS

SEQ ID NO: 1092 - protein, 115 aa, synthetic construct
EVQLVESGGGLVKPGGSLRLSCAASGFTFSDAWMYWDRQAPGKGLEWVGRIKSKTDGGTTDYAAPVKGRFTISRDDSKNTLYLQMNSLKTEDTAVYYCRADMDVWGKGTTVTVSS

SEQ ID NO: 1093 - protein, 115 aa, synthetic construct
EVQLVESGGGVVRPGGSLRLSCAASGFTFDDYGMSWVRQAPGKGLEWVSGINWNGGSTGYADSVKGRFTISRDNAKNSLYLQMNSLRAEDTALYYCARDRGFDYWGQGTLVTVSS

SEQ ID NO: 1094 - protein, 115 aa, synthetic construct
EVQLVESGGGLIQPGGSLRLSCAASGFTVSSNYMSWVRQAPGKGLEWVSVIYSGGSTYYADSVKGRFTISRDNSKNTLYLQMNSLRAEDTAVYYCARGGDYFDYWGQGTLVTVSS

SEQ ID NO: 1095 - protein, 115 aa, synthetic construct
QVQLVQSGAEVKKPGASVKVSCKTSGYTFTSFGISWVRQAPGQGLEWMGWISAYNDNINYAQKLQDRVTMTTDTSTSTACMELRSLRSDDTAVYFCARGASFDFWGQGTLVTVSS

SEQ ID NO: 1096 - protein, 115 aa, synthetic construct
EVQLVESGGGLVQPGGSLKLSCAASGFTFSGSAMHWVRQASGKGLEWVGRIRSKANSYATAYAASVKGRFTISRDDSKNTAYLQMNSLKTEDTAVYYCTGPFDYWGQGTLVTVSS

SEQ ID NO: 1097 - protein, 115 aa, synthetic construct
EVQLVESGGGLIQPGGSLRLSCAASGFTVSSNYMSWVRQAPGKGLEWVSVIYSGGSTYYADSVKGRFTISRDNSKNTLYLQMNSLRAEDTAVYYCARSFDAFDIWGQGTMVTVSS

SEQ ID NO: 1098 - protein, 116 aa, synthetic construct
EVQLVESGGGLVKPGGSLRLSCAASGFTFSSYSMNWVRQAPGKGLEWVSSISSSSSYIYYADSVKGRFTISRDNAKNSLYLQMNSLRAEDTAVYYCAGLTGELDYWGQGTLVTVSS

SEQ ID NO: 1099 - protein, 116 aa, synthetic construct
EVQLVESGGGLVQPGGSLRLSCAASGFTFSSYDMHWVRQATGKGLEWVSAIGTAGDTYYPGSVKGRFTISRENAKNSLYLQMNSLRAGDTAVYYCARWGTGGFDYWGQGTLVTVSS

SEQ ID NO: 1100 - protein, 116 aa, synthetic construct
EVQLVESGGGLVKPGGSLRLSCAASGFTFSSYSMNWVRQAPGKGLEWVSSISSSSSYIYYADSVKGRFTISRDNAKNSLYLQMNSLRAEDTAVYYCARREGFFDYWGQGTLVTVSS

SEQ ID NO: 1101 - protein, 116 aa, synthetic construct
EVQLVESGGGLVQPGGSLRLSCAASGFTFSSYWMSWVRQAPGKGLEWVANIKQDGSEKYYVDSVKGRFTISRDNAKNSLYLQMNSLRAEDTAVYYCARDQLAPDYWGQGTLVTVSS

SEQ ID NO: 1102 - protein, 116 aa, synthetic construct
EVQLVESGGGLVQPGGSLRLSCAASGFTFSSYAMSWVRQAPGKGLEWVSAISGSGGSTYYADSVKGRFTISRDNSKNTLYLQMNSLRAEDTAVYYCAKDSSGFDYWGQGTLVTVSS

SEQ ID NO: 1103 - protein, 116 aa, synthetic construct
EVQLVESGGGLVQPGGSLRLSCAASGFTFSSYAMSWVRQAPGKGLEWVSAISGSGGSTYYADSVKGRFTISRDNSKNTLYLQMNSLRAEDTAVYYCAKDPQFFDYWGQGTLVTVSS

SEQ ID NO: 1104 - protein, 116 aa, synthetic construct
EVQLVESGGGLVQPGGSLRLSCAASGFTFSSYAMSWVRQAPGKGLEWVSAISGSGGSTYYADSVKGRFTISRDNSKNTLYLQMNSLRAEDTAVYYCAKDGTAFDIWGQGTMVTVSS

SEQ ID NO: 1105 - protein, 117 aa, synthetic construct
QVQLVESGGGVVQPGRSLRLSCAASGFTFSSYGMHWVRQAPGKGLEWVAVIWYDGSNKYYADSVKGRFTISRDNSKNTLYLQMNSLRAEDTAVYYCARDRGWGLDYWGQGTLVTVSS

SEQ ID NO: 1106 - protein, 117 aa, synthetic construct
QVQLVESGGGVVQPGRSLRLSCAASGFPFSNSGMHWVRQAPGKGLEWVTIISYDGNSKYYADSVKGRFTISRDNSKNTLYLQMNSLRTEDTAVYYCARGELGDFDYWGRGTLVTVSS

SEQ ID NO: 1107 - protein, 117 aa, synthetic construct
QVQLVQSGAEVKKPGASVKVSCKASGYTFTGYYMHWVRQAPGQGLEWMGWINPNSGGTNYAQKFQGRVTMTRDTSISTAYMELSRLRSDDTAVYYCARVLELYFDYWGQGTLVTVSS

SEQ ID NO: 1108 - protein, 117 aa, synthetic construct
EVQLVESGGGLVKPGGSLRLSCAASGFTFSNAWMSWVRQAPGKGLEWVGRIKSKTDGGTTDYAAPVKGRFTISRDDSKNTLYLQMNSLKTEDTAVYYCTTRSDFQHWGQGTLVTVSS

SEQ ID NO: 1109 - protein, 118 aa, synthetic construct
QVQLVQSGAEVKKPGASVKVSCKASGYTFTSYDINWVRQATGQGLEWMGWMNPNSGNTGYAQKFQGRVTMTRNTSISTAYMELSSLRSEDTAVYYCARDQELRVFDYWGQGTLVTVSS

SEQ ID NO: 1110 - protein, 118 aa, synthetic construct
QVQLVESGGGVVQPGRSLRLSCAASGFTFSSYGMHWVRQAPGKGLEWVAVISYDGSNKYYADSVKGRFTISRDNSKNTLYLQMNSLRAEDTAVYYCAKASGYGPFDYWGQGTLVTVSS

SEQ ID NO: 1111 - protein, 118 aa, synthetic construct
EVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARHSSSSHFDYWGQGTLVTVSS

SEQ ID NO: 1112 - protein, 118 aa, synthetic construct
EVQLVESGGGLVKPGGSLRLSCAASGFTFSSYSMNWVRQAPGKGLEWVSSISSSSSYIYYADSVKGRFTISRDNAKNSLYLQMNSLRAEDTAVYYCARDRGNSLFDYWGQGTLVTVSS

SEQ ID NO: 1113 - protein, 118 aa, synthetic construct
QVQLVQSGAEVKKPGASVKVSCKASGYTFTGYYMHWVRQAPGQGLEWMGWINPNSGGTNYAQKFQGRVTMTRDTSISTAYMELSRLRSDDTAVYYCARDKSLEWFDYWGQGTLVTVSS

SEQ ID NO: 1114 - protein, 118 aa, synthetic construct
EVQLVESGGGLVQPGGSLRLSCAASGFTFSSYDMHWVRQATGKGLEWVSAIGTAGDTYYPGSVKGRFTISRENAKNSLYLQMNSLRAGDTAVYYCARGDWNYGGFDYWGQGTLVTVSS

SEQ ID NO: 1115 - protein, 118 aa, synthetic construct
EVQLVESGGGLVKPGGSLRLSCAASGFTFSNAWMSWVRQAPGKGLEWVGRIKSKTDGGTTDYAAPVKGRFTISRDDSKNTLYLQMNSLKTEDTAVYYCTTAPDAFDIWGQGTMVTVSS

SEQ ID NO: 1116 - protein, 118 aa, synthetic construct
EVQLVESGGGLVQPGGSLRLSCAASGFTFSSYAMSWVRQAPGKGLEWVSAISGSGGSTYYADSVKGRFTISRDNSKNTLYLQMNSLRAEDTAVYYCASGITGTTGDYWGQGTLVTVSS

SEQ ID NO: 1117 - protein, 118 aa, synthetic construct
EVQLVESGGGLVQPGGSLRLSCAASGFTFSSYAMSWVRQAPGKGLEWVSAISGSGGSTYYADSVKGRFTISRDNSKNTLYLQMNSLRAEDTAVYYCAKEGAHDAFDIWGQGTMVTVSS

SEQ ID NO: 1118 - protein, 118 aa, synthetic construct
EVQLVESGGGLVQPGGSLRLSCAASGFTFSSYAMSWVRQAPGKGLEWVSAISGSGGSTYYADSVKGRFTISRDNSKNTLYLQMNSLRAEDTAVYYCAKDKGELPFDYWGQGTLVTVSS

SEQ ID NO: 1119 - protein, 118 aa, synthetic construct
QVQLVESGGGVVQPGRSLRLSCAASGFTFSSYGMHWVRQAPGKGLEWVAVIWYDGSNKYYADSVKGRFTISRDNSKNTLYLQMNSLRAEDTAVYYCAKLGVRDYMDVWGKGTTVTVSS

SEQ ID NO: 1120 - protein, 118 aa, synthetic construct
EVQLVESGGGVVRPGGSLRLSCAASGFTFDDYGMSWVRQAPGKGLEWVSGINWNGGSTGYADSVKGRFTISRDNAKNSLYLQMNSLRAEDTALYYCAREGGGWVFDYWGQGTLVTVSS

SEQ ID NO: 1121 - protein, 118 aa, synthetic construct
EVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARGGGGDPFDYWGQGTLVTVSS

SEQ ID NO: 1122 - protein, 118 aa, synthetic construct
QVQLVQSGAEVKKPGASVQVSCKASGYTFTGYYIHWVRQAPGQGLEWMGWINPNSGGTNYAQKFQGRVIMTRDTSISIAYIELSRLRSDDTAVYYCARPYNWNSFDYWGQGTLVTVSS

SEQ ID NO: 1123 - protein, 118 aa, synthetic construct
EVQLVESGGDLVQPGRSLRLSCAASGFTFDDHAIHWVRQAPGKGLEWVSGVTWNSNIIGYADSVKGRFTISRDIAKNSLYLQMNSLRPEDTALYYCAKDNDWNGFDYWGQGTLVTVSS

SEQ ID NO: 1124 - protein, 118 aa, synthetic construct
EVQLVESGGGLVQPGRSLRLSCAASGFTFDDYAMHWVRQAPGKGLEWVSGISWNSGSIGYADSVKGRFTISRDNAKNSLYLQMNSLRAEDTALYYCAKDNWNYAFDIWGQGTMVTVSS

SEQ ID NO: 1125 - protein, 118 aa, synthetic construct
EVQLVESGGGLVQPGGSLRLSCTASGFTFSSYWMHWVRQAPGKGLVWVSRVNSDGGNTIYADSVKGRFTISRDNAKNTLYLQMNSLRAEDTAIYYCARDLDWTLFDYWGQGTLVTVSS

SEQ ID NO: 1126 - protein, 119 aa, synthetic construct
EVQLVESGGGLVQPGGSLRLSCAASGFTFSSYWMSWVRQAPGKGLEWVANIKQDGSEKYYVDSVKGRFTISRDNAKNSLYLQMNSLRAEDTAVYYCAGDYSNYGWFDPWGQGTLVTVSS

SEQ ID NO: 1127 - protein, 119 aa, synthetic construct
QVQLVQSGAEVKKPGASVKVSCKASGYTFTSYDINWVRQATGQGLEWMGWMNPNSGNTGYAQKFQGRVTMTRNTSISTAYMELSSLRSEDTAVYYCARARDSGYYMDVWGKGTTVTVSS

SEQ ID NO: 1128 - protein, 119 aa, synthetic construct
QVQLVESGGGVVQPGRSLRLSCAASGFTFSSYGMHWVRQAPGKGLEWVAVIWYDGSNKYYADSVKGRFTISRDNSKNTLYLQMNSLRAEDTAVYYCARATAMVTGIDYWGQGTLVTVSS

SEQ ID NO: 1129 - protein, 119 aa, synthetic construct
EVQLVESGGGLVQPGGSLKLSCAASGFTFSGSAMHWVRQASGKGLEWVGRIRSKANSYATAYAASVKGRFTISRDDSKNTAYLQMNSLKTEDTAVYYCTGSSGSYFDYWGQGTLVTVSS

SEQ ID NO: 1130 - protein, 119 aa, synthetic construct
EVQLVESGGGLVKPGGSLRLSCAASGFTFSSYSMNWVRQAPGKGLEWVSSISSSSSYIYYADSVKGRFTISRDNAKNSLYLQMNSLRAEDTAVYYCARSPYNWNYVDYWGQGTLVTVSS

SEQ ID NO: 1131 - protein, 119 aa, synthetic construct
QVQLVQSGAEVKKPGASVKVSCKVSGYTLTELSMHWVRQAPGKGLEWMGGFDPEDGETIYAQKFQGRVTMTEDTSTDTAYMDLSSLRSEDTAVYYCATEGPSTFSFDYWGQGTLVTVSS

SEQ ID NO: 1132 - protein, 119 aa, synthetic construct
QVQLVQSGAEVKKPGASVKVSCKVSGYTLTELSMHWVRQAPGKGLEWMGGFDPEDGETIYAQKFQGRVTMTEDTSTDTAYMDLSSLRSEDTAVYYCATANWNDEAFDIWGQGTMVTVSS

SEQ ID NO: 1133 - protein, 119 aa, synthetic construct
EVQLVESGGGLVQPGGSLRLSCAASGFTFSSYSMNWVRQAPGKGLEWVSYISSSSSTIYYADSVKGRFTISRDNAKNSLYLQMNSLRDEDTAVYYCARDELTGDAFDIWGQGTMVTVSS

SEQ ID NO: 1134 - protein, 119 aa, synthetic construct
EVQLVESGGGLVKPGGSLRLSCAASGFTFSNAWMSWVRQAPGKGLEWVGRIKSKTDGGTTDYAAPVKGRFTISRDDSKNTLYLQMNSLKTEDTAVYYCTTEALGIFDYWGQGTLVTVSS

SEQ ID NO: 1135 - protein, 119 aa, synthetic construct
EVQLVESGGGLVKPGGSLRLSCAASGFTFSSYSMNWVRQAPGKGLEWVSSISSSSSYIYYADSVKGRFTISRDNAKNSLYLQMNSLRAEDTAVYYCARDGSSGFLFDYWGQGTLVTVSS

SEQ ID NO: 1136 - protein, 119 aa, synthetic construct
EVQLVESGGGLVQPGGSLRLSCAASGFTFSSYAMSWVRQAPGKGLEWVSAISGSGGSTYYADSVKGRFTISRDNSKNTLYLQMNSLRAEDTAVYYCAKHYYDSRSFDYWGQGTLVTVSS

SEQ ID NO: 1137 - protein, 119 aa, synthetic construct
QVQLQESGPGLVKPSGTLSLTCAVSGGSISSSDWWTWVRQPPGRGLEWIGEINHSGTTNYNPSLKSRVTISVDKSKNQFSLKLSSVTAADTAVYYCARDFQGTGPFDYWGQGTLVTVSS

SEQ ID NO: 1138 - protein, 120 aa, synthetic construct
QVQLQQWGAGLLKPSETLSLTCAVFGGSFSGYYWSWIRQPPGKGLEWIGEINHSGSTNYNPSLKSRVTISVDTSKNQFSLKLTSVTAADTTVYYCARGRLYSGSFSFDYWGQGTLVTVSS

SEQ ID NO: 1139 - protein, 120 aa, synthetic construct
EVQLVESGGGLVQPGGSLRLSCAASGFTFSSYWMSWVRQAPGKGLEWVANIKQDGSEKYYVDSVKGRFTISRDNAKNSLYLQMNSLRAEDTAVYYCARDGGYNWNFFDYWGQGTLVTVSS

SEQ ID NO: 1140 - protein, 120 aa, synthetic construct
QITLKESGPMLVKPTQTLTLTCTFSGFSLSTSGVGVGWIRQPPGKALEWLALIYWNDDKRYSPSLKSRLTITRDTSKNQVVLTMTNMDPVDTATYYCTHRDAAMVYFDYWGQGTLVTVSS

SEQ ID NO: 1141 - protein, 120 aa, synthetic construct
QVQLVQSGAEVKKPGASVKVSCKASGYTFTSYGISWVRQAPGQGLEWMGWISAYNGNTNYAQKLQGRVTMTTDTSTSTAYMELRSLRSDDTAVYYCARWYYGSGSYFDYWGQGTLVTVSS

SEQ ID NO: 1142 - protein, 120 aa, synthetic construct
EVQLVESGGGLVQPGGSRRLSCAASGFTFSRYDMHWVRQGTGKGLEWVSGINTAGDTYYSGSVKGRFTISRENAKNSLHLQMNSLRAGDTAVYYCARGWNYGSGSCFDNWGQGTLVTVSS

SEQ ID NO: 1143 - protein, 120 aa, synthetic construct
EVQLVESGGGLVQPGGSLRLSCAASGFTFSSSDMHWVRQAPGEGLEWVSAIYTTGDTYYPGSVQGRFTISRENAKNSLYLQMNSLRAGDTAVYYCARGFSGTYYGDFDYWGQGTLVTVSS

SEQ ID NO: 1144 - protein, 120 aa, synthetic construct
EVQLVESGGGLVQPGGSLRLSCAASGFTFSSYSMNWVRQAPGKGLEWVSYISSSSSTIYYADSVKGRFTISRDNAKNSLYLQMNSLRDEDTAVYYCAREGEWEPLHMDVWGKGTTVTVSS

SEQ ID NO: 1145 - protein, 120 aa, synthetic construct
EVQLVESGGGLVQPGGSLRLSCAASGFTFSSYAMSWVRQAPGKGLEWVSAISGSGGSTYYADSVKGRFTISRDNSKNTLYLQMNSLRAEDTAVYYCAKSLSGSYVYMDVWGKGTTVTVSS

SEQ ID NO: 1146 - protein, 120 aa, synthetic construct
QVQLVESGGGVVQPGRSLRLSCAASGFTFSSYGMHWVRQAPGKGLEWVAVISYDGSNKYYADSVKGRFTISRDNSKNTLYLQMNSLRAEDTAVYYCAKGFLEWLLGFDYWGQGTLVTVSS

SEQ ID NO: 1147 - protein, 120 aa, synthetic construct
QVQLVESGGGLVKPGGSLRLSCAASGFTFSDYYMSWIRQAPGKGLEWVSYISSSGSTIYYADSVKGRFTISRDNSKNTLYLQMNSLRAEDTAVYYCARDGGSSGYYSDYWGQGTLVTVSS

SEQ ID NO: 1148 - protein, 120 aa, synthetic construct
EVQLVESGGGLVQPGGSLRLSCAASGFTFSEYWMHWVRQAPGKGLVWVARINSDGSRTDYADSVKGRFTISRNNAKNRLNLQIDSLRAEDTAVYYCTRDLVYSSGWYDYWGQGTLVTVSS

SEQ ID NO: 1149 - protein, 120 aa, synthetic construct
EVQLVESGGGLVQPGGSLRLSCAASGFTFSSYWMHWVRQAPGKGLVWVSRINSDGSGTSYADSVKGRFTISRDNAKNTLYLQMNSLRAEDTAVYYCAREGIKASDAFDIWGQGTMVTVSS

SEQ ID NO: 1150 - protein, 120 aa, synthetic construct
EVQLVESGGGLVQPGRSLRLSCAASGFTFDDYAMHWVRQAPGKGLEWVSGISWNSGSIGYADSVKGRFTISRDNAKNSLYLQMNSLRAEDTALYYCAKDIDPSITGTDYWGQGTLVTVSS

SEQ ID NO: 1151 - protein, 120 aa, synthetic construct
QVQLVESGGGLVKPGGSLRLSCAASGFTFSDYYMSWIRQAPGKGLEWVSYISHSGTTVYYADSVKGRFTISRDNAKISLYLQMNSLRAEDTAVYYCAGLRHFDWLGFDSWGQGTLVTVSS

SEQ ID NO: 1152 - protein, 120 aa, synthetic construct
EVQLVESGGGLVQPGGSLRLSCAASGFTFSSYAMNWVRQAPGKGLEWVSIINDSGYSTYYADSVKGRFTISRDNSKNTLYLQMNSLRAEDTALYYCAKEDNWNYGWFDPWGQGTLVTVSS

SEQ ID NO: 1153 - protein, 120 aa, synthetic construct
EVQLVESGGGLVQPGGSLRLSCAASGFTFSSYDMHWVRQATGKGLEWVSAIGTAGDTYYPGSVKGRFTISRENAKNSLYLQMNSLRAGDTAVYYCAREETGTTSWYFDLWGRGTLVTVSS

SEQ ID NO: 1154 - protein, 120 aa, synthetic construct
EVQLVESGGGLVQPGGSLRLSCAASGFTFSSYSMNWVRQAPGKGLEWVSYISSSSSTIYYADSVKGRFTISRDNAKNSLYLQMNSLRDEDTAVYYCARGYSYGYWYFDLWGRGTLVTVSS

SEQ ID NO: 1155 - protein, 121 aa, synthetic construct
QVQLVQSGAEVKKPGASVKVSCKVSGYTLTELSMHWVRQAPGKGLEWMGGFDPEDGETIYAQKFQGRVTMTEDTSTDTAYMDLSSLRSEDTAVYYCATPYCSGGSCHFDYWGQGTLVTVSS

SEQ ID NO: 1156 - protein, 121 aa, synthetic construct
EVQLVESGGGLVKPGGSLRLSCAASGFTFSSYSMNWVRQAPGKGLEWVSSISSSSSYIYYADSVKGRFTISRDNAKNSLYLQMNSLRAEDTAVYYCARDDYGGNSVYFDYWGQGTLVTVSS

SEQ ID NO: 1157 - protein, 121 aa, synthetic construct
QVQLVESGGGAVQPGRSLRLSCVASGFTFSNYDMHWVRQAPGKGLEWVAVIWSDGSNKYYSDSVKGRFTISRDNSKNTLYLQMTSLSAEDSALSYCVRAARYSGTYIFDYWGQGTLVTVSS

SEQ ID NO: 1158 - protein, 121 aa, synthetic construct
EVQLVESGGGLVKPGGSLRLSCAASGFTFSNAWMSWVRQAPGKGLEWVGRIKSKTDGGTTDYAAPVKGRFAISRDDSKNTLYLQMNSLKTEDTAVYYCTTDPGYSYGVDYWGQGTLVTVSS

SEQ ID NO: 1159 - protein, 121 aa, synthetic construct
EVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARPEYSSSSGYFQHWGQGTLVTVSS

SEQ ID NO: 1160 - protein, 121 aa, synthetic construct
EVQLVESGGGLVQPGGSLRLSCAASGFTFSSYWMSWVRQAPGKGLEWVANIKQDGSEKYYVDSVKGRFTISRDNAKNSLYLQMNSLRAEDTAVYYCAREYNWNYEDAFDIWGQGTMVTVSS

SEQ ID NO: 1161 - protein, 121 aa, synthetic construct
QITLKESGPTLVKPTQTLTLTCTFSGFSLSTSGVGVGWIRQPPGKALEWLALIYWNDDKRYSPSLKSRLTITKDTSKNQVVLTMTNMDPVDTATYYCAHRRGSYSNWFDPWGQGTLVTVSS

SEQ ID NO: 1162 - protein, 121 aa, synthetic construct
QIQLVQSGAEVKKPGASVKVSCTASGYTFSSYGITWVRQAPGQGLEWMGWISAYNGNTHYAQNLQGRVTMTTDTSTTTAYMDLRSLRSDDTAIYYCARTLFGVVKNWFDPWGQGTLVTVSS

SEQ ID NO: 1163 - protein, 114 aa, synthetic construct
QVQLVQSGASVKVSCKASGYTFTGYYMHWVRQAPGQGLEWMGWINPNSGGTNYAQKFQGRVTMTRDTSISTAYMELSRLRSDDTAVYYCAREVLGGGDCPFDYWGQGTLVTVSS

SEQ ID NO: 1164 - protein, 121 aa, synthetic construct
QVQLVQSGAEVRKPVASVKVSCKASGYTFTDHSIHWVRQAPGQGLEWMGSINPNSGGTNYAQKFQGRVTMTWDTYNSTAFMELSRLRSDDTAVYYCARSDGGSHYVFFDDWGQGTLVTVSS

SEQ ID NO: 1165 - protein, 121 aa, synthetic construct
EVQLVESGGGLVQPGRSLRLSCAASGFTFDDYAMHWVRQAPGKGLEWVSGISWNSGSIGYADSVKGRFTISRDNAKNSLYLQMNSLRAEDTALYYCAKDIAYSSSGHFDYWGQGTLVTVSS

SEQ ID NO: 1166 - protein, 121 aa, synthetic construct
QVQLQESGPGLVKPSGTLSLTCVVSGGSITSSNWWSWVRQPPGKGLEWIGEIYHSGNTNYNPSLKSRVTISVDKSKNQFSLRLSSVTAADTAVYYCARAPLTGTTNWFDPWGQGTLVTVSS

SEQ ID NO: 1167 - protein, 122 aa, synthetic construct
EVQLVESGGGLVKPGGSLRLSCAASGFTFSSYSMNWVRQAPGKGLEWVSSISSSSSYIYYADSVKGRFTISRDNAKNSLYLQMNSLRAEDTAVYYCAGVLYYDSSGYPFDYWGQGTLVTVSS

SEQ ID NO: 1168 - protein, 122 aa, synthetic construct
QVQLVQSGSELKKPGASVKVSCKASGYTFTSYAMNWVRQAPGQGLEWMGWINTNTGNPTYAQGFTGRFVFSLDTSVSTAYLQISSLKAEDTAVYYCARDPLAARPVGWFDPWGQGTLVTVSS

SEQ ID NO: 1169 - protein, 122 aa, synthetic construct
EVQLVESGGGLVKPGGSLRLSCAASGFTFSSYSMNWVRQAPGKGLEWVSSISSSSSYIYYADSVKGRFTISRDNAKNSLYLQMNSLRAEDTAVYYCAREDGYSSGWNYFDYWGQGTLVTVSS

SEQ ID NO: 1170 - protein, 122 aa, synthetic construct
QVQLVQSGAEVKKPGASVKVSCKVSGYTLTELSMHWVRQAPGKGLEWMGGFDPEDGETIYAQKFQGRVTMTEDTSTDTAYMDLSSLRSEDTAVYYCATGGQTIVAARVFDYWGQGTLVTVSS

SEQ ID NO: 1171 - protein, 122 aa, synthetic construct
QVQLVQSGSELKKPGASVKVSCKASGYTVTRHALNWVRQAPGQGLEWMGWINTNTGTPTYAQGFIGRFVFTLDTSVSTAYLQINSLKAEDTAVYYCARDQTPSDHYYYMDVWGKGTTVTVSS

SEQ ID NO: 1172 - protein, 122 aa, synthetic construct
LAHLVQSGAEVKRPGASVKVSCKAFGYAFRGQHIHWVRQAPGQGLEWMGWIRPNSGDTNYSQKFQGRVTMTRDTSITTAYMELTRLRSDDSAVYYCARDRGITMRLDNMDVWGKGTMVTVSS

SEQ ID NO: 1173 - protein, 122 aa, synthetic construct
EVQLVESGGTLVQPGGSLTLSCAASGFTFSDSAMHWVRQASGKGLEWVGRIRGKPNTYATAYAASVKGRFTISKDDSKNTAFLQMNSLKTEDRAVYYCTRRYNWNDVGFDYWGQGTLVTVSS

SEQ ID NO: 1174 - protein, 123 aa, synthetic construct
QITLKESGPTLVKPTQTLTLTCTFSGFSLSTSGVGVGWIRQPPGKALEWLALIYWNDDKRYSPSLKSRLTITKDTSKNQVVLTMTNMDPVDTATYYCAHRPGITGNTGYFDYWGQGTLVTVSS

SEQ ID NO: 1175 - protein, 123 aa, synthetic construct
QVQLVQSGAEVKKPGASVKVSCKASGYTFTSYGISWVRQAPGQGLEWMGWISAYNGNTNYAQKLQGRVTMTTDTSTSTAYMELRSLRSDDTAVYYCARCRYSGSLTSYYMDVWGKGTTVTVSS

SEQ ID NO: 1176 - protein, 123 aa, synthetic construct
EVQLVESGGGLVQPGRSLRLSCAASGFTFDDYAMHWVRQAPGKGLEWVSGISWNSGSIGYADSVKGRFTISRDNAKNSLYLQMNSLRAEDTALYYCAKDMITGTTNYYYMDVWGKGTTVTVSS

SEQ ID NO: 1177 - protein, 123 aa, synthetic construct
EVQLVESGGGLVQPGRSLRLSCAASGFTFDDYAMHWVRQAPGKGLEWVSGISRNSGSVGYADSVRGRFTISRDNAKNSLYLQMNSLRAEDTALYYCAKGGYDFWSGYYPFDPWGQGTLVTVSS

SEQ ID NO: 1178 - protein, 123 aa, synthetic construct
EVQLVESGGGLVKPGGSLRLSCAASGFTFSNAWMSWVRQAPGKGLEWVGRIKSKTDGGTTDYAAPVKGRFTISRDDSKNTLYLQMNSLKTEDTAVYYCTTEGTTVTTWAFDIWGQGTMVTVSS

SEQ ID NO: 1179 - protein, 122 aa, synthetic construct
QVQLQQSGPGLVKPSQTLSLTCAISGDSVSSNSAAWNWIRQSPSRGLEWLGRTYYRSKWYNDYAVSVKSRITINPDTSKNQFSLQLNSVTPEDTAVYYCASSGSYSDAFDIWGQGTMVTVSS

SEQ ID NO: 1180 - protein, 123 aa, synthetic construct
QVQLVQSGSELKKPGASVMVSCKASGYTFTRNGINWLRQAPGQGLEWMGWIDTHTGNPTYVQGFTGRFVFSLDTSVNTAYLQISSLRAEDTAVYYCAKDRTGYYHYYYFMDVWGKGTAVTVSS

SEQ ID NO: 1181 - protein, 123 aa, synthetic construct
QVQLVQSGTEMKKPGASVKVSCKASGYTFTTYGISWVRQAPGQGLEWMGWISAYNGNTNYAQKLQARVTMTTDTSTNTAYMELRSLRSDDTAVYYCARSGYNWKYDYYYMDVWGKGTTVTVSS

SEQ ID NO: 1182 - protein, 124 aa, synthetic construct
EVQLVESGGGLVQPGGSLRLSCAASGFTFSSYWMSWVRQAPGKGLEWVANIKQDGSEKYYVDSVKGRFTISRDNAKNSLYLQMNSLRAEDTAVYYCAREGGYDFWSGLNWFDPWGQGTLVTVSS

SEQ ID NO: 1183 - protein, 124 aa, synthetic construct
QVQLVQSGAEVKKPGASVKVSCKASGYTFTSYGISWVRQAPGQGLEWMGWISAYNGNTNYAQKLQGRVTMTTDTSTSTAYMELRSLRSDDTAVYYCARAGGIAAAGTGYWFDPWGQGTLVTVSS

SEQ ID NO: 1184 - protein, 124 aa, synthetic construct; identical to SEQ ID NO: 457

SEQ ID NO: 1185 - protein, 123 aa, synthetic construct
QVQLQQSGPGLVKPSQTLSLTCAISGDSVSSNSAAWNWIRQSPSRGLEWLGRTYYRSKWYNDYAVSVKSRITINPDTSKNQFSLQLNSVTPEDTAVYYCARDLELRGGAFDIWGQGTMVTVSS

SEQ ID NO: 1186 - protein, 125 aa, synthetic construct
EVHLVESGGGLVRPGGSLRLSCEVSGFTFSTYSMNWVRQAPGKGLEWVSSISSRSSYIYYADSVKGRFTISRDNAKNSLYLQMNSLRAEDTAVYYCTRGEGATWGNYHCYYMDVWGKGTTVIVSS

SEQ ID NO: 1187 - protein, 125 aa, synthetic construct
QVQLVQSGAEVKKPGASVKVSCKASGYSFTGYYMHWVRQAPGQGLEWMGWINPNSGGTNYAQKFQGRVTMTWDTSISTAYMELSRLRSDDTAVYYCARDQITMVRGFLGDWFDPWGQGTLVTVSS

SEQ ID NO: 1188 - protein, 118 aa, synthetic construct
QLQLQESGPGLVKPSETLSLTCTVSGGSISSSSYYWGWIRQPPGKGLEWIGSIYYSGSTYYNPSLKSRVTISVDTSKNQFSLKLSSVTAADTAVYYCARGYSYEFDYWGQGTLVTVSS

SEQ ID NO: 1189 - protein, 124 aa, synthetic construct
QVQLQQSGPGLVKPSQTLSLTCAISGDSVSSNSAAWNWIRQSPSRGLEWLGRTYYRSKWYNDYAVSVKSRITINPDTSKNQFSLQLNSVTPEDTAVYYCAREEIVGATTAFDIWGQGTMVTVSS

SEQ ID NO: 1190 - protein, 124 aa, synthetic construct
QVQLQQSGPGLVKPSQTLSLTCAISGDSVSSNSAAWNWIRQSPSRGLEWLGRTYYRSKWYNDYAVSVKSRITINPDTSKNQFSLQLNSVTPEDTAVYYCARDYGGNSGWYFDLWGRGTLVTVSS

SEQ ID NO: 1191 - protein, 118 aa, synthetic construct
QVQLQQWGAGLLKPSETLSLTCAVYGGSFSGHYWNWIRQPPGKGLEWIGEINHSGFTNYNPSLKSRVTISVDTPKNQFSLNLSSVTAADTAVYYCAREGLTGHVFDIWGQGTMVTVSS

SEQ ID NO: 1192 - protein, 124 aa, synthetic construct
QVQVQQSGPGLVKPSQTLSLTCAISGDSVSSNSAAWNWIRQSPSRGLEWLGRTYYRSKWYNDFAVSVKSRITINPDTSKNQFSLQLNSVTPEDTAVYYCARGGGSGSYDWFDPWGQGTLVTVSS

SEQ ID NO: 1193 - protein, 126 aa, synthetic construct
EVRLVESGGGLVKPGGSLRLSCAASGFIFSSYSMTWVRQAPGKGLEWVSSISGSSSFVKYGDSVKGRFTISRDNAKNSLYLQMNSLRAEDTAVYYCAREGVLCSGGSCYREIFDYWGQVTLVTVSS

SEQ ID NO: 1194 - protein, 127 aa, synthetic construct
EVQLVESGEGLVKPGGSLRLSCVASGFDFTNAWMSWVRQAPGRGLEWVGRIKSKTDGGSIDYAAPVKGRFTISRDDSKTTLYLQMTSLRTEDTAVYYCSTSPYYDFWSGYYGYIDYWGQGTLVTVSS

SEQ ID NO: 1195 - protein, 127 aa, synthetic construct
EVHLVESGGGLVKPGGSLRLSCVASRFTFSSAWMTWVRQVPGKGLEWIGRIKTKTEGGTTEYAAPVKGRFAISRDDSKKTLYLQMNSLKTEDTAVYYCSTSPYFDFWSGYYGYLDYWGQGTLVTVSS

SEQ ID NO: 1196 - protein, 120 aa, synthetic construct
QLQLQESGPGLVKPSETLSLTCTVSGGSISSSSYYWGWIRQPPGKGLEWIGSIYYSGSTYYNPSLKSRVTISVDTSKNQFSLKLSSVTAADTAVYYCARHAAAGGWFDPWGQGTLVTVSS

SEQ ID NO: 1197 - protein, 121 aa, synthetic construct
QLQLQESGPGLVKPSETLSLTCTVSGGSISSSSYYWGWIRQPPGKGLEWIGSIYYSGSTYYNPSLKSRVTISVDTSKNQFSLKLSSVTAADTAVYYCARRSSSGIGAFDIWGQGTMVTVSS

SEQ ID NO: 1198 - protein, 121 aa, synthetic construct
QVQLQQWGAGLLKPSETLSLTCAVYGGSFSGYYWSWIRQPPGKGLEWIGEINHSGSTNYNPSLKSRVTISVDTSKNQFSLKLSSVTAADTAVYYCARGRGIAARPPYFDYWGQGTLVTVSS

SEQ ID NO: 1199 - protein, 122 aa, synthetic construct
QLQLQESGPGLVKPSETLSLTCTVSGGSISSSSYYWGWIRQPPGKGLEWIGSIYYSGSTYYNPSLKSRVTISVDTSKNQFSLKLSSVTAADTAVYYCASEYSSSSLDAFDIWGQGTMVTVSS

SEQ ID NO: 1200 - protein, 123 aa, synthetic construct
QVQLQQWGAGLLKPSETLSLTCAVYGGSFSGYYWSWIRQPPGKGLEWIGEINHSGSTNYNPSLKSRVTISVDTSKNQFSLKLSSVTAADTAVYYCARGTTVVTPTEYYYMDVWGKGTTVTVSS

SEQ ID NO: 1201 - protein, 131 aa, synthetic construct
QVQLVQSGAEVKKPGASVKVSCKASGYTFTSYDINWVRQATGQGLEWMGWLNPKNGYTGYSHKFQGRVTMTRNTSISTAYMELSSLRSEDAAVYFCARRGDFWSGYYSTSQNIVIHWFDSWGLGTLVTVSS

SEQ ID NO: 1202 - protein, 110 aa, synthetic construct; identical to SEQ ID NO: 734

SEQ ID NO: 1203 - protein, 108 aa, synthetic construct
SYELTQPPSVSVSPGQTARITCSGDALPKKYAYWYQQKSGQAPVLVIYEDSKRPSGIPERFSGSSSGTMATLTISGAQVEDEADYYCYSTDSSGNHSVFGTGTKVTVL

SEQ ID NO: 1204 - protein, 111 aa, synthetic construct; identical to SEQ ID NO: 783

SEQ ID NO: 1205 - protein, 106 aa, synthetic construct; identical to SEQ ID NO: 673

SEQ ID NO: 1206 - protein, 107 aa, synthetic construct; identical to SEQ ID NO: 742

SEQ ID NO: 1207 - protein, 111 aa, synthetic construct
QSVLTQPPSVSGAPGQRVTISCTGSSSNIGAGYDVHWYQQLPGTAPKLLIYGNSNRPSGVPDRFSGSKSGTSASLAITGLQAEDEADYYCQSYDSSLSGSVFGGGTKLTVL

SEQ ID NO: 1208 - protein, 110 aa, synthetic construct; identical to SEQ ID NO: 772

SEQ ID NO: 1209 - protein, 110 aa, synthetic construct; identical to SEQ ID NO: 696

SEQ ID NO: 1210 - protein, 108 aa, synthetic construct; identical to SEQ ID NO: 746

SEQ ID NO: 1211 - protein, 108 aa, synthetic construct; identical to SEQ ID NO: 637

SEQ ID NO: 1212 - protein, 110 aa, synthetic construct
QSVLTQPPSASGTPGQRVTISCSGSSSNIGSNTVNWYQQLPGTAPKLLIYSNNQRPSGVPDRFSGSKSGTSASLAISGLQSEDEADYYCAAWDDSLNGPVFGGGTKLTVL

SEQ ID NO: 1213 - protein, 110 aa, synthetic construct
QSALTQPPSASGSPGQSVTISCTGTSSDVGGYNYVSWYQQHPGKAPKLMIYEVSKRPSGVPDRFSGSKSGNTASLTVSGLQAEDEADYYCSSYAGSNNYVFGTGTKVTVL

SEQ ID NO: 1214 - protein, 110 aa, synthetic construct; identical to SEQ ID NO: 670

SEQ ID NO: 1215 - protein, 106 aa, synthetic construct
SYELTQPLSVSVALGQTARITCGGNNIGSKNVHWYQQKPGQAPVLVIYRDSNRPSGIPERFSGSNSGNTATLTISRAQAGDEADYYCQVWDSSTVVFGGGTKLTVL

SEQ ID NO: 1216 - protein, 108 aa, synthetic construct; identical to SEQ ID NO: 656

SEQ ID NO: 1217 - protein, 110 aa, synthetic construct; identical to SEQ ID NO: 658

SEQ ID NO: 1218 - protein, 106 aa, synthetic construct
SYELTQPPSVSVSPGQTASITCSGDKLGDKYACWYQQKPGQSPVLVIYQDSKRPSGIPERFSGSNSGNTATLTISGTQAMDEADYYCQAWDSSTGVFGGGTKLTVL

SEQ ID NO: 1219 - protein, 107 aa, synthetic construct; identical to SEQ ID NO: 721

SEQ ID NO: 1220 - protein, 108 aa, synthetic construct; identical to SEQ ID NO: 661

SEQ ID NO: 1221 - protein, 108 aa, synthetic construct
SYELTQPPSVSVSPGQTARITCSGDALPKKYAYWYQQKSGQAPVLVIYEDSKRPSGIPERFSGSSSGTMATLTISGAQVEDEADYYCYSIDSSGNHRVFGGGTKLTVL

SEQ ID NO: 1222 - protein, 108 aa, synthetic construct; identical to SEQ ID NO: 661

SEQ ID NO: 1223 - protein, 108 aa, synthetic construct; identical to SEQ ID NO: 661

SEQ ID NO: 1224 - protein, 110 aa, synthetic construct
QSALTQPASVSGSPGQSITISCTGTSSDVGGYNYVSWYQQHPGKAPKLMIYEVSDRPSGVSNRFSGSKSGNTASLTISGLQAEDEADYYCSSYTRSSTCVFGGGTKLTVL

SEQ ID NO: 1225 - protein, 110 aa, synthetic construct; identical to SEQ ID NO: 627

SEQ ID NO: 1226 - protein, 111 aa, synthetic construct; identical to SEQ ID NO: 648

SEQ ID NO: 1227 - protein, 106 aa, synthetic construct; identical to SEQ ID NO: 630

SEQ ID NO: 1228 - protein, 107 aa, synthetic construct
SYELTQPPSVSVSPGQTARITCSADALPKQYAYWYQQKPGQAPVLVIYKDSERPSGIPERFSGSSSGTTVTLTISGVQAEDEADYYCQSADSSGTWVFGGGTKLTVL

SEQ ID NO: 1229 - protein, 108 aa, synthetic construct; identical to SEQ ID NO: 661

SEQ ID NO: 1230 - protein, 108 aa, synthetic construct; identical to SEQ ID NO: 661

SEQ ID NO: 1231 - protein, 108 aa, synthetic construct; identical to SEQ ID NO: 661

SEQ ID NO: 1232 - protein, 108 aa, synthetic construct; identical to SEQ ID NO: 661

SEQ ID NO: 1233 - protein, 108 aa, synthetic construct; identical to SEQ ID NO: 661

SEQ ID NO: 1234 - protein, 106 aa, synthetic construct
SYELTQPLSVSVALGQTARITCGGNNIGSKNVHWYQQKPGQAPVLVIYRDSNRPSGIPERFSGSNSGNTATLTISRAQAGDEADYYCQVWDSSTGVFGGGTKLTVL

SEQ ID NO: 1235 - protein, 108 aa, synthetic construct; identical to SEQ ID NO: 678

SEQ ID NO: 1236 - protein, 109 aa, synthetic construct
QTVVTQEPSLTVSPGGTVTLTCASSTGAVTSGYYPNWFQQKPGQAPRALIYSTSNKHSWTPARFSGSLLGGKAALTLSGVQPEDEAEYYCLLYYGGAVVFGGGTKLTVL

SEQ ID NO: 1237 - protein, 110 aa, synthetic construct; identical to SEQ ID NO: 659

SEQ ID NO: 1238 - protein, 106 aa, synthetic construct; identical to SEQ ID NO: 663

SEQ ID NO: 1239 - protein, 106 aa, synthetic construct; identical to SEQ ID NO: 663

SEQ ID NO: 1240 - protein, 106 aa, synthetic construct; identical to SEQ ID NO: 663

SEQ ID NO: 1241 - protein, 108 aa, synthetic construct; identical to SEQ ID NO: 661

SEQ ID NO: 1242 - protein, 108 aa, synthetic construct; identical to SEQ ID NO: 661

SEQ ID NO: 1243 - protein, 108 aa, synthetic construct; identical to SEQ ID NO: 661

SEQ ID NO: 1244 - protein, 108 aa, synthetic construct; identical to SEQ ID NO: 661

SEQ ID NO: 1245 - protein, 108 aa, synthetic construct; identical to SEQ ID NO: 661

SEQ ID NO: 1246 - protein, 108 aa, synthetic construct; identical to SEQ ID NO: 661

SEQ ID NO: 1247 - protein, 108 aa, synthetic construct; identical to SEQ ID NO: 661

SEQ ID NO: 1248 - protein, 108 aa, synthetic construct; identical to SEQ ID NO: 666

SEQ ID NO: 1249 - protein, 108 aa, synthetic construct; identical to SEQ ID NO: 666

SEQ ID NO: 1250 - protein, 108 aa, synthetic construct; identical to SEQ ID NO: 661

SEQ ID NO: 1251 - protein, 110 aa, synthetic construct
QSALTQPASVSGSLGQSITISCTGTSSDVGGYNYVSWYQHHPGKAPKIMIYDVSNRPSGVSNRFSASKSGNTASLTISGLQTEDEADYYCSSYTTSSTWVFGGGTNLTVL

SEQ ID NO: 1252 - protein, 110 aa, synthetic construct
QSALTQPASVSGSPGQSITISCTGTSSDVGGYNYVSWYQQHPGKAPKLMIYEVSNRPSVISYRFSGSKSGNTASLTISGLQAEDEADYYCNSYTTNTTRVFGGGTKLTVL

SEQ ID NO: 1253 - protein, 110 aa, synthetic construct
QSALTQPASVSGSPGQSITISCTGTSSDVGGYNYVSWYQQHPGKAPKLMIYEVSNRPSGVSNRFSGSKSGNTASLTISGLQAEDEADYYCSSYTSSSTRVFGGGTKLTVL

SEQ ID NO: 1254 - protein, 115 aa, synthetic construct
QAVLTQPASLSASPGASASLTCTLRSGIYVGTYRIYWYQQKPGSPPQYLLRYKSDSDKQQGSGVPSRFSGSKDVSANAGILLISGLQSEDEADYYCMTWHSSAVVFGGGTKLTVL

SEQ ID NO: 1255 - protein, 105 aa, synthetic construct
SYELTQPPSVSVSPGQTASITCSGDKLGDKYACWYQQKPGQSPVLVIYQDSKRPSGIPERFSGSNSGNTATLTISGTQAMDEADYYCQAWDSSTVFGGGTKLTVL

SEQ ID NO: 1256 - protein, 106 aa, synthetic construct; identical to SEQ ID NO: 663

SEQ ID NO: 1257 - protein, 106 aa, synthetic construct
SYELTQPSSVSVSPGQTARITCSGDVLAKKYARWFQQKPGQAPVLVIYKDSERPSGIPERFSGSSSGTTVTLTISGAQVEDEADYYCYSAADNNWVFGGGTKLTVL

SEQ ID NO: 1258 - protein, 106 aa, synthetic construct; identical to SEQ ID NO: 630

SEQ ID NO: 1259 - protein, 108 aa, synthetic construct; identical to SEQ ID NO: 661

SEQ ID NO: 1260 - protein, 108 aa, synthetic construct; identical to SEQ ID NO: 661

SEQ ID NO: 1261 - protein, 108 aa, synthetic construct; identical to SEQ ID NO: 678

SEQ ID NO: 1262 - protein, 108 aa, synthetic construct; identical to SEQ ID NO: 661

SEQ ID NO: 1263 - protein, 108 aa, synthetic construct; identical to SEQ ID NO: 661

SEQ ID NO: 1264 - protein, 109 aa, synthetic construct
QTVVTQEPSLTVSPGGTVTLTCASSTGAVTSGYYPNWFQQKPGQAPRALIYSTSNKHSWTPARFSGSLLGGKAALTLSGVQPEDEAEYYCLLYYGGAWVFGGGTKLTVL

SEQ ID NO: 1265 - protein, 110 aa, synthetic construct; identical to SEQ ID NO: 633

SEQ ID NO: 1266 - protein, 111 aa, synthetic construct
QSALTQPPSVSGAPGQRVTISCTGSSSNIGAGYDVHWFQQLPGTAPKLLIYDNNNRPSGVPNRFSGSKSGTSASLAITGLQADFEADYYCQSYDGSLNGWVFGGGTKLTVL

SEQ ID NO: 1267 - protein, 108 aa, synthetic construct
SSELTQDPAVSVALGQTVRITCQGDSLRNYYASWYQQKPGQAPVLVIYGKNNRPSGIPDRFSGSSSGNIASLTITGAQAEDEADYYCKSRDRSGNHWVFGGGTKVTVL

SEQ ID NO: 1268 - protein, 108 aa, synthetic construct; identical to SEQ ID NO: 636

SEQ ID NO: 1269 - protein, 108 aa, synthetic construct; identical to SEQ ID NO: 666

SEQ ID NO: 1270 - protein, 108 aa, synthetic construct; identical to SEQ ID NO: 661

SEQ ID NO: 1271 - protein, 108 aa, synthetic construct
SSELTQDPAVSVALGQTVRITCQGDNLRNYSVSWCQQRPGQAPTLVIFGKNNRPSGIPDRFSGSNSGNTASLTITGAQAEDEADYYCNSRDISGKHWVFGGGTKLTVL

SEQ ID NO: 1272 - protein, 108 aa, synthetic construct; identical to SEQ ID NO: 656

SEQ ID NO: 1273 - protein, 108 aa, synthetic construct; identical to SEQ ID NO: 661

SEQ ID NO: 1274 - protein, 108 aa, synthetic construct; identical to SEQ ID NO: 661

SEQ ID NO: 1275 - protein, 108 aa, synthetic construct; identical to SEQ ID NO: 666

SEQ ID NO: 1276 - protein, 108 aa, synthetic construct; identical to SEQ ID NO: 679

SEQ ID NO: 1277 - protein, 108 aa, synthetic construct
SSELTQDPAVSVALGQTVRITCQGDSLRSYYANWYQQKPGQAPILVIYGKNNRPSGIPDRFSGSSSGNTASLTITGAQAEDESDYYCNSRDSSGNHWVFGGGTKLTVL

SEQ ID NO: 1278 - protein, 108 aa, synthetic construct
SSELTQDPAVSVALGQTVRITCQGDSLRTYYASWYQQKPGQAPILVIYGKNNRPSGIPDRFSGSSSGNTASLTITGAQAEDEADYSCNSRDSSGSHVVFGGGTKLTVL

SEQ ID NO: 1279 - protein, 109 aa, synthetic construct
SYELTQPPSVSVSPGQTARITCSGDALPKKYAYWYQQKSGQAPVLVIYEDSKRPSGIPERFSGSSSGTMATLTISGAQVEDEADYYCYSTDSSGNHSVVFGGGTKLTVL

SEQ ID NO: 1280 - protein, 109 aa, synthetic construct; identical to SEQ ID NO: 1264

SEQ ID NO: 1281 - protein, 110 aa, synthetic construct
QSALTQPASVSGSPGQSITISCTGTSSDVGGYNYVSWYQQHPGKAPKVIIYEVIIRPSGVSPRFSGSKSGKMASLTISGLQAEDEADYYCSSYTSSSTWVFGGGTKLTVL

SEQ ID NO: 1282 - protein, 111 aa, synthetic construct
QSALTQPASVSGSPGQSITISCTGTSSDVGGYNYVSWYQQHPGKAPKLMIYEVSNRPSGVSNRFSGSKSGNTASLTISGLQAEDEADYYCSSYTSSSTLYVFGTGTKVTVL

SEQ ID NO: 1283 - protein, 111 aa, synthetic construct
QSALTQPASVSGSPGQSITISCTGTSSDVGGYNYVSWYQQHPGKAPKLMIYEVSNRPSGVSNRFSGSKSGNTASLTISGLQAEDEADYYCSSYTSSSTPYVFGTGTKVTVL

SEQ ID NO: 1284 - protein, 106 aa, synthetic construct; identical to SEQ ID NO: 663

SEQ ID NO: 1285 - protein, 108 aa, synthetic construct; identical to SEQ ID NO: 661

SEQ ID NO: 1286 - protein, 108 aa, synthetic construct
SYVLTQSPSMSVAPGKTARITCGGNNIGSKSVHWYQQRPGQAPVLVIYYDSDRPSGIPERFSGSNSGNTATLTISRVEAGDEAVYYCQVWDSSSYHYVFGTGTKVAVL

SEQ ID NO: 1287 - protein, 108 aa, synthetic construct; identical to SEQ ID NO: 661

SEQ ID NO: 1288 - protein, 108 aa, synthetic construct; identical to SEQ ID NO: 661

SEQ ID NO: 1289 - protein, 109 aa, synthetic construct
QTVVTQEPSLTVSPGGTVTLTCASSTGAVTSGYYPNWFQQKPGQAPRALIYSTSNKHSWTPARFSGSLLGGKAALTLSGVQPEDEAEYYCLLYYGGAQVFGGGTKLTVL

SEQ ID NO: 1290 - protein, 110 aa, synthetic construct; identical to SEQ ID NO: 683

SEQ ID NO: 1291 - protein, 110 aa, synthetic construct
QSVLSQPPSVSEAPRQRVTISCSGSSSNIGNNAVNWYQKLPGKAPKLLISHDVLLSSGVSDRFSGSKSGTSASLAISGLQSEDEADYYCAAWDGRLNEWVFGGGTKLTVL

SEQ ID NO: 1292 - protein, 110 aa, synthetic construct
QSVLTQPPSASGTPGQRVTISCSGSSSNIGSNTVNWYQQLPGTAPKLLIYSNNQRPSGVPDRFSGSKSGTSASLAISGLQSEDEADYYCAAWDDSLNGVVFGGGTKLTVL

SEQ ID NO: 1293 - protein, 110 aa, synthetic construct
QSVLTQPPSVSEAPRQRVTISCSGSISNIGNNAVSWYQQVPGKAPKLLIYYDDLLPSGVSDRFSGSRSVTSASLAISGLQSEDDADYYCTAWDDRLNGPVFGGGTKLTVL

SEQ ID NO: 1294 - protein, 110 aa, synthetic construct; identical to SEQ ID NO: 633

SEQ ID NO: 1295 - protein, 111 aa, synthetic construct
QSVLTQPPSVSGAPGQRVTISCSGSSSNIGAGYDVHWYQQLPGTGPKVLIYGNRNRPSGVPDRFSGSKSGTSASLVITGLQAEDEADYSCQSYDSSLSGWVFGGGTKLTVL

SEQ ID NO: 1296 - protein, 106 aa, synthetic construct; identical to SEQ ID NO: 630

SEQ ID NO: 1297 - protein, 106 aa, synthetic construct; identical to SEQ ID NO: 786

SEQ ID NO: 1298 - protein, 108 aa, synthetic construct; identical to SEQ ID NO: 666

SEQ ID NO: 1299 - protein, 108 aa, synthetic construct; identical to SEQ ID NO: 679

SEQ ID NO: 1300 - protein, 108 aa, synthetic construct
SSELTQDPAVSVALGQTVRITCQGDSLRSYYASWYQQKPGQAPVLVIYGKNNRPSGIPDRFSGSSSGNTASLTITGAQAEDEADYYCNSRDSSGNHYVFGTGTKVTVL

SEQ ID NO: 1301 - protein, 108 aa, synthetic construct; identical to SEQ ID NO: 678

SEQ ID NO: 1302 - protein, 110 aa, synthetic construct
QSALTQPASVSGSPGQSITISCTGTSSDVGAYNYVSWYQQHPGKAPKFMIYDVSKRPSGVSNRFSGSKSGNTASLTISGLQAEDEADYYCCSYAGSNTYVFGTGTRVTVL

SEQ ID NO: 1303 - protein, 106 aa, synthetic construct; identical to SEQ ID NO: 663

SEQ ID NO: 1304 - protein, 106 aa, synthetic construct; identical to SEQ ID NO: 663

SEQ ID NO: 1305 - protein, 106 aa, synthetic construct; identical to SEQ ID NO: 663

SEQ ID NO: 1306 - protein, 107 aa, synthetic construct
SYELTQPLSVSVALGQTARITCGENNIVNKNVHWYQQKPGQAPVLVIYRDGNRPSGIPERFSGSNSGNTATLTISRAQAGDEADYYCQVWDNNTPWVFGGGTKLTVL

SEQ ID NO: 1307 - protein, 108 aa, synthetic construct; identical to SEQ ID NO: 661

SEQ ID NO: 1308 - protein, 108 aa, synthetic construct; identical to SEQ ID NO: 661

SEQ ID NO: 1309 - protein, 110 aa, synthetic construct
QSVLTQPPSASGAPGQRVTMSCSGSSSNIERTAVNWYSHLPGAAPKLLIYSNDQRPLGVPDRFAGSKSGSSASLAISGLQSEDEAAYFCAAWDDSLNGWLFGGGTKLTVL

SEQ ID NO: 1310 - protein, 112 aa, synthetic construct
QSVLTQPPSVSGAPGQRVTISCTGNSSNIGADYDVQWYQQFPGTAPKLLIYANIIRPSGVPDRFSGSKSGTSASLAITGLQAEDEADYYCQSYDSSLSGSLVFGGGTKLTVL

SEQ ID NO: 1311 - protein, 108 aa, synthetic construct; identical to SEQ ID NO: 661

SEQ ID NO: 1312 - protein, 108 aa, synthetic construct; identical to SEQ ID NO: 661

SEQ ID NO: 1313 - protein, 108 aa, synthetic construct; identical to SEQ ID NO: 645

SEQ ID NO: 1314 - protein, 108 aa, synthetic construct; identical to SEQ ID NO: 661

SEQ ID NO: 1315 - protein, 108 aa, synthetic construct; identical to SEQ ID NO: 661

SEQ ID NO: 1316 - protein, 108 aa, synthetic construct; identical to SEQ ID NO: 678

SEQ ID NO: 1317 - protein, 108 aa, synthetic construct; identical to SEQ ID NO: 661

SEQ ID NO: 1318 - protein, 108 aa, synthetic construct; identical to SEQ ID NO: 748

SEQ ID NO: 1319 - protein, 108 aa, synthetic construct; identical to SEQ ID NO: 661

SEQ ID NO: 1320 - protein, 110 aa, synthetic construct
QSALTQPASVSGSPGQSITISCTGTSSDVGVYNYVSWYQQHPTKAPKLMIYEVSNRPSGVSNRFSGSKSGNTASLTISGLQAEDEADYYCSSYTSSITWVFGGGTKLTVL

SEQ ID NO: 1321 - protein, 110 aa, synthetic construct; identical to SEQ ID NO: 627

SEQ ID NO: 1322 - protein, 108 aa, synthetic construct; identical to SEQ ID NO: 678

SEQ ID NO: 1323 - protein, 111 aa, synthetic construct
QSVLTQPPSVSGAPGQRVTISCTGSSSNIGAGYAVHWYQQFPGIAPKLLIYGNINRPSGVPDRFSGSKSDTSASLAITGLQAEDEADYYCQSFDSSLSGVMFGGGTKLTVL

SEQ ID NO: 1324 - protein, 113 aa, synthetic construct
WAQSVLTQPPSVSGAPGQRVTISCSGSSSNIGAGYAVHWYQLLPGTVPKLLIYGNLNRPSGVPDRFSGSMSDTSVSLAITGLQAEDEADYYCQSYDSSLSGVVFGGGTKVTVL

SEQ ID NO: 1325 - protein, 115 aa, synthetic construct; identical to SEQ ID NO: 638

SEQ ID NO: 1326 - protein, 106 aa, synthetic construct; identical to SEQ ID NO: 663

SEQ ID NO: 1327 - protein, 108 aa, synthetic construct; identical to SEQ ID NO: 679

SEQ ID NO: 1328 - protein, 108 aa, synthetic construct; identical to SEQ ID NO: 661

SEQ ID NO: 1329 - protein, 106 aa, synthetic construct; identical to SEQ ID NO: 663

SEQ ID NO: 1330 - protein, 111 aa, synthetic construct; identical to SEQ ID NO: 1207

SEQ ID NO: 1331 - protein, 11 aa, synthetic construct
CARWGRGFDPW

SEQ ID NO: 1332 - protein, 14 aa, synthetic construct
CARERLELRWFDPW

SEQ ID NO: 1333 - protein, 12 aa, synthetic construct
CARQTDYWFDPW

SEQ ID NO: 1334 - protein, 15 aa, synthetic construct
CAREGGIAVAGFDYW

SEQ ID NO: 1335 - protein, 16 aa, synthetic construct [sequence omitted]

SEQ ID NO: 1336 - protein, 15 aa, synthetic construct
CAREETMVRGVIAYW

SEQ ID NO: 1337 - protein, 11 aa, synthetic construct
CARDWGSFDLW

SEQ ID NO: 1338 - protein, 17 aa, synthetic construct
CARDGGEYSSSYYFDYW

SEQ ID NO: 1339 - protein, 11 aa, synthetic construct
CARHDPSFDYW

SEQ ID NO: 1340 - protein, 13 aa, synthetic construct
CARERSNWDFDYW

SEQ ID NO: 1341 - protein, 17 aa, synthetic construct
CARDGGVRGVITYFDYW

SEQ ID NO: 1342 - protein, 16 aa, synthetic construct
CARGRGSSWYWYFDLW

SEQ ID NO: 1343 - protein, 13 aa, synthetic construct
CARGSSSSAFDIW

SEQ ID NO: 1344 - protein, 15 aa, synthetic construct [sequence omitted]

SEQ ID NO: 1345 - protein, 15 aa, synthetic construct
CARADSLTGGFFDYW

SEQ ID NO: 1346 - protein, 11 aa, synthetic construct
CAERGWNYDYW

SEQ ID NO: 1347 - protein, 14 aa, synthetic construct
CARDSTTVTLFDYW

SEQ ID NO: 1348 - protein, 16 aa, synthetic construct
CARGIAVAGPHAFDIW

SEQ ID NO: 1349 - protein, 12 aa, synthetic construct
CARGYSGSYAYW

SEQ ID NO: 1350 - protein, 14 aa, synthetic construct
CARKWELRDAFDIW

SEQ ID NO: 1351 - protein, 16 aa, synthetic construct
CAKRRMTGSHSWFDPW

SEQ ID NO: 1352 - protein, 7 aa, synthetic construct [sequence omitted]

SEQ ID NO: 1353 - protein, 8 aa, synthetic construct
CARDGGTP

SEQ ID NO: 1354 - protein, 11 aa, synthetic construct
CAIVGARFDYW

SEQ ID NO: 1355 - protein, 8 aa, synthetic construct
CTTGGTHW

SEQ ID NO: 1356 - protein, 8 aa, synthetic construct
CTTGGYRW

SEQ ID NO: 1357 - protein, 8 aa, synthetic construct
CTTDLYYW

SEQ ID NO: 1358 - protein, 10 aa, synthetic construct
CARGWYFDYW

SEQ ID NO: 1359 - protein, 10 aa, synthetic construct
CAKRVFFDYW

SEQ ID NO: 1360 - protein, 12 aa, synthetic construct
CARDLGRVFDYW

SEQ ID NO: 1361 - protein, 11 aa, synthetic construct
CATDLNWNGYW

SEQ ID NO: 1362 - protein, 12 aa, synthetic construct
CATGYNWNPDYW

SEQ ID NO: 1363 - protein, 12 aa, synthetic construct
CARDRSSSSDYW

SEQ ID NO: 1364 - protein, 12 aa, synthetic construct
CAGITGTYFDYW

SEQ ID NO: 1365 - protein, 12 aa, synthetic construct
CAKDSGYSPDYW

SEQ ID NO: 1366 - protein, 12 aa, synthetic construct
CARDRPYYFDYW

SEQ ID NO: 1367 - protein, 12 aa, synthetic construct
CARGGWGTMDVW

SEQ ID NO: 1368 - protein, 13 aa, synthetic construct
CARAWELDAFDIW

SEQ ID NO: 1369 - protein, 12 aa, synthetic construct
CAKDNWNYFDYW

SEQ ID NO: 1370 - protein, 12 aa, synthetic construct
CARVYNWIFDYW

SEQ ID NO: 1371 - protein, 12 aa, synthetic construct
CARITVVSFDYW

SEQ ID NO: 1372 - protein, 12 aa, synthetic construct
CAKAAAGKGDYW

SEQ ID NO: 1373 - protein, 12 aa, synthetic construct
CARGDWGTMDVW

SEQ ID NO: 1374 - protein, 12 aa, synthetic construct
CARDGTGWFDPW

SEQ ID NO: 1375 - protein, 12 aa, synthetic construct [sequence omitted]

SEQ ID NO: 1376 - protein, 12 aa, synthetic construct
CARPLSGTLDNW

SEQ ID NO: 1377 - protein, 13 aa, synthetic construct
CARESIAALFDYW

SEQ ID NO: 1378 - protein, 14 aa, synthetic construct
CARGDHSYGGLDYW

SEQ ID NO: 1379 - protein, 13 aa, synthetic construct
CARGDWAWSFDLW

SEQ ID NO: 1380 - protein, 13 aa, synthetic construct
CARGLRRDWFDPW

SEQ ID NO: 1381 - protein, 11 aa, synthetic construct
CTTGTGRSDYW

SEQ ID NO: 1382 - protein, 13 aa, synthetic construct
CVRGGVGDGFDMW

SEQ ID NO: 1383 - protein, 13 aa, synthetic construct
CASVGSYGYFQHW

SEQ ID NO: 1384 - protein, 13 aa, synthetic construct
CARKGNWNSFDYW

SEQ ID NO: 1385 - protein, 13 aa, synthetic construct
CARDSAYYTFDYW

SEQ ID NO: 1386 - protein, 13 aa, synthetic construct
CGSGWYEGAFDYW

SEQ ID NO: 1387 - protein, 15 aa, synthetic construct
CARDRDSSHDAFDIW

SEQ ID NO: 1388 - protein, 14 aa, synthetic construct
CVRDEIWNYYFDYW

SEQ ID NO: 1389 - protein, 14 aa, synthetic construct
CARDSYDFHAFDIW

SEQ ID NO: 1390 - protein, 14 aa, synthetic construct
CARVGWGGHAFDIW

SEQ ID NO: 1391 - protein, 14 aa, synthetic construct
CARGYNWNYVGDYW

SEQ ID NO: 1392 - protein, 14 aa, synthetic construct
CAKDANWGYAFDIW

SEQ ID NO: 1393 - protein, 15 aa, synthetic construct
CARRFIWNYGDFDYW

SEQ ID NO: 1394 - protein, 15 aa, synthetic construct
CARGRLGIEDYFDYW

SEQ ID NO: 1395 - protein, 15 aa, synthetic construct
CARECYSSSWAFDYW

SEQ ID NO: 1396 - protein, 15 aa, synthetic construct
CARDVGVDGRGFDYW

SEQ ID NO: 1397 - protein, 15 aa, synthetic construct
CARDILWSGGYLDVW

SEQ ID NO: 1398 - protein, 15 aa, synthetic construct
CARKQLWLNWYFDFW

SEQ ID NO: 1399 - protein, 15 aa, synthetic construct
CARENNWNYGWFDPW

SEQ ID NO: 1400 - protein, 16 aa, synthetic construct
CAREGYGDYPLPMDVW

SEQ ID NO: 1401 - protein, 13 aa, synthetic construct
CTTDNWNSYFDYW

SEQ ID NO: 1402 - protein, 15 aa, synthetic construct
CAGNSGYDSPYFDYW

SEQ ID NO: 1403 - protein, 15 aa, synthetic construct
CAREYSSSSDWFDPW

SEQ ID NO: 1404 - protein, 15 aa, synthetic construct
CARDGGITGRYFDLW

SEQ ID NO: 1405 - protein, 15 aa, synthetic construct
CAREGNWGPYYFDYW

SEQ ID NO: 1406 - protein, 15 aa, synthetic construct
CARGVWSGYYTFDPW

SEQ ID NO: 1407 - protein, 13 aa, synthetic construct
CTPHSSSPVFDYW

SEQ ID NO: 1408 - protein, 16 aa, synthetic construct
CARDDTGTTGGYFQHW

SEQ ID NO: 1409 - protein, 16 aa, synthetic construct
CARAVAVAGTGWFDPW

SEQ ID NO: 1410 - protein, 14 aa, synthetic construct
CTTNYGDYVGFDYW

SEQ ID NO: 1411 - protein, 16 aa, synthetic construct
CAREIDWNYGFHFDYW

SEQ ID NO: 1412 - protein, 16 aa, synthetic construct
CARGYYDFWSGPFDYW

SEQ ID NO: 1413 - protein, 16 aa, synthetic construct
CARDSKWELLNWFDPW

SEQ ID NO: 1414 - protein, 17 aa, synthetic construct
CARGRHFDWLLSYFDYW

SEQ ID NO: 1415 - protein, 24 aa, synthetic construct
CARDRAIVGATWFDPWGQGTLVIV

SEQ ID NO: 1416 - protein, 16 aa, synthetic construct
CARDRYNWNYRYFDLW

SEQ ID NO: 1417 - protein, 16 aa, synthetic construct
CARDSHDYGDSYFDYW

SEQ ID NO: 1418 - protein, 16 aa, synthetic construct
CARDGAARPPRYMDVW

SEQ ID NO: 1419 - protein, 16 aa, synthetic construct
CARSDSGSHYVFFDDW

SEQ ID NO: 1420 - protein, 16 aa, synthetic construct
CARDLDYYGSGNYDYW

SEQ ID NO: 1421 - protein, 16 aa, synthetic construct
CARNRDYHGSGSFDYW

SEQ ID NO: 1422 - protein, 12 aa, synthetic construct
CARDWNFAFDIW

SEQ ID NO: 1423 - protein, 16 aa, synthetic construct
CARTIFGVVNNWFDPW

SEQ ID NO: 1424 - protein, 16 aa, synthetic construct
CARDGEQLALNWFDPW

SEQ ID NO: 1425 - protein, 16 aa, synthetic construct
CARETPVTLFDAFDIW

SEQ ID NO: 1426 - protein, 16 aa, synthetic construct
CAKDIFTGRAGYFDYW

SEQ ID NO: 1427 - protein, 16 aa, synthetic construct
CARAITGTTGNWFDPW

SEQ ID NO: 1428 - protein, 15 aa, synthetic construct
CTHTEYGSSWSVDYW

SEQ ID NO: 1429 - protein, 16 aa, synthetic construct
CARHFDWLLSNAFDIW

SEQ ID NO: 1430 - protein, 17 aa, synthetic construct
CVRRITVVRGVISLDYW

SEQ ID NO: 1431 - protein, 17 aa, synthetic construct [sequence omitted]

SEQ ID NO: 1432 - protein, 18 aa, synthetic construct
CARDDTIFGVVTDAFDIW

SEQ ID NO: 1433 - protein, 14 aa, synthetic construct
CARGVGARGWFDPW

SEQ ID NO: 1434 - protein, 18 aa, synthetic construct
CARDPPLSGSYAGEFDYW

SEQ ID NO: 1435 - protein, 17 aa, synthetic construct
CARRRGYSYGWGDFDYW

SEQ ID NO: 1436 - protein, 18 aa, synthetic construct
CARGGLLNWNYEGWFDPW

SEQ ID NO: 1437 - protein, 18 aa, synthetic construct
CARDGGIAARPDWYFDLW

SEQ ID NO: 1438 - protein, 18 aa, synthetic construct
CARTYYYGSGSYYTLDYW

SEQ ID NO: 1439 - protein, 18 aa, synthetic construct
CARGGITIFGVVTPFDYW

SEQ ID NO: 1440 - protein, 18 aa, synthetic construct
CARDALHYYGSGSAFDYW

SEQ ID NO: 1441 - protein, 19 aa, synthetic construct
CAREGVLWFGEFYYYMDVW

SEQ ID NO: 1442 - protein, 19 aa, synthetic construct
CARDGDYYDSSGYYHFDYW

SEQ ID NO: 1443 - protein, 19 aa, synthetic construct
CAKDRGGENWNYGGWFDPW

SEQ ID NO: 1444 - protein, 19 aa, synthetic construct
CAGAYYYDSSGYLNYMDVW

SEQ ID NO: 1445 - protein, 17 aa, synthetic construct
CTTDHIEYSSLYYFDYW

SEQ ID NO: 1446 - protein, 19 aa, synthetic construct
CARQLAYCGGDCYLYFDYW

SEQ ID NO: 1447 - protein, 15 aa, synthetic construct
CAREAYWNYGGFDYW

SEQ ID NO: 1448 - protein, 20 aa, synthetic construct
CARDGRITMVRGVRNWFDPW

SEQ ID NO: 1449 - protein, 20 aa, synthetic construct
CARMSSQLELHYYCYYMDVW

SEQ ID NO: 1450 - protein, 18 aa, synthetic construct
CTTDLGYSGYDWGAFDYW

SEQ ID NO: 1451 - protein, 16 aa, synthetic construct
CARDRVNWNDVGFDYW

SEQ ID NO: 1452 - protein, 20 aa, synthetic construct
CARTPGYSSSWYEGPYFDYW

SEQ ID NO: 1453 - protein, 12 aa, synthetic construct
CAREDLIGNDYW

SEQ ID NO: 1454 - protein, 12 aa, synthetic construct
CAREDLIGNDYW

SEQ ID NO: 1455 - protein, 14 aa, synthetic construct
CAREGLTGHVFDIW

SEQ ID NO: 1456 - protein, 14 aa, synthetic construct
CAREGLTGHTFDIW

SEQ ID NO: 1457 - protein, 21 aa, synthetic construct
CARGVWGSYRSHSYYTFMDVW

SEQ ID NO: 1458 - protein, 21 aa, synthetic construct
CARDYRPYYDILTGYSHFDYW

SEQ ID NO: 1459 - protein, 21 aa, synthetic construct
CARRVLWFGELRDYFYYMDVW

SEQ ID NO: 1460 - protein, 20 aa, synthetic construct
CVRQGYDSWTGYSFFYFDYW

SEQ ID NO: 1461 - protein, 15 aa, synthetic construct
CARGGGYSFGGFDYW

SEQ ID NO: 1462 - protein, 14 aa, synthetic construct
CARQNWGSDAFDIW

SEQ ID NO: 1463 - protein, 16 aa, synthetic construct
CARGELGIGYWYFDLW

SEQ ID NO: 1464 - protein, 16 aa, synthetic construct
CAREGGTTHEPLFDYW

SEQ ID NO: 1465 - protein, 27 aa, synthetic construct
CARAPGGSCGSTNCYKWNYDPYYFDYW

SEQ ID NO: 1466 - protein, 27 aa, synthetic construct
CARAPGGDCSSTSCYKWNYDPYYFDYW

SEQ ID NO: 1467 - protein, 11 aa, synthetic construct [sequence omitted]

SEQ ID NO: 1468 - protein, 12 aa, synthetic construct [sequence omitted]

SEQ ID NO: 1469 - protein, 12 aa, synthetic construct [sequence omitted]

SEQ ID NO: 1470 - protein, 12 aa, synthetic construct [sequence omitted]

SEQ ID NO: 1471 - protein, 11 aa, synthetic construct [sequence omitted]

SEQ ID NO: 1472 - protein, 12 aa, synthetic construct [sequence omitted]

SEQ ID NO: 1473 - protein, 13 aa, synthetic construct [sequence omitted]

SEQ ID NO: 1474 - protein, 12 aa, synthetic construct [sequence omitted]

SEQ ID NO: 1475 - protein, 15 aa, synthetic construct [sequence omitted]

SEQ ID NO: 1476 - protein, 13 aa, synthetic construct [sequence omitted]

SEQ ID NO: 1477 - protein, 11 aa, synthetic construct [sequence omitted]

SEQ ID NO: 1478 - protein, 11 aa, synthetic construct [sequence omitted]

SEQ ID NO: 1479 - protein, 11 aa, synthetic construct [sequence omitted]

SEQ ID NO: 1480 - protein, 11 aa, synthetic construct [sequence omitted]

SEQ ID NO: 1481 - protein, 14 aa, synthetic construct [sequence omitted]

SEQ ID NO: 1482 - protein, 11 aa, synthetic construct [sequence omitted]

SEQ ID NO: 1483 - protein, 12 aa, synthetic construct [sequence omitted]

SEQ ID NO: 1484 - protein, 13 aa, synthetic construct [sequence omitted]

SEQ ID NO: 1485 - protein, 13 aa, synthetic construct [sequence omitted]

SEQ ID NO: 1486 - protein, 16 aa, synthetic construct
CCSYAGRSTLGIDWVF

SEQ ID NO: 1487 - protein, 13 aa, synthetic construct [sequence omitted]

SEQ ID NO: 1488 - protein, 12 aa, synthetic construct [sequence omitted]

SEQ ID NO: 1489 - protein, 13 aa, synthetic construct [sequence omitted]

SEQ ID NO: 1490 - protein, 11 aa, synthetic construct [sequence omitted]

SEQ ID NO: 1491 - protein, 12 aa, synthetic construct [sequence omitted]

SEQ ID NO: 1492 - protein, 13 aa, synthetic construct [sequence omitted]

SEQ ID NO: 1493 - protein, 13 aa, synthetic construct [sequence omitted]

SEQ ID NO: 1494 - protein, 12 aa, synthetic construct [sequence omitted]

SEQ ID NO: 1495 - protein, 12 aa, synthetic construct [sequence omitted]

SEQ ID NO: 1496 - protein, 13 aa, synthetic construct [sequence omitted]

SEQ ID NO: 1497 - protein, 12 aa, synthetic construct [sequence omitted]

SEQ ID NO: 1498 - protein, 11 aa, synthetic construct [sequence omitted]

SEQ ID NO: 1499 - protein, 11 aa, synthetic construct [sequence omitted]

SEQ ID NO: 1500 - protein, 11 aa, synthetic construct [sequence omitted]

SEQ ID NO: 1501 - protein, 12 aa, synthetic construct [sequence omitted]

SEQ ID NO: 1502 - protein, 13 aa, synthetic construct [sequence omitted]

SEQ ID NO: 1503 - protein, 13 aa, synthetic construct [sequence omitted]

SEQ ID NO: 1504 - protein, 13 aa, synthetic construct [sequence omitted]

SEQ ID NO: 1505 - protein, 13 aa, synthetic construct [sequence omitted]

SEQ ID NO: 1506 - protein, 13 aa, synthetic construct [sequence omitted]

SEQ ID NO: 1507 - protein, 12 aa, synthetic construct [sequence omitted]

SEQ ID NO: 1508 - protein, 12 aa, synthetic construct [sequence omitted]

SEQ ID NO: 1509 - protein, 12 aa, synthetic construct
CTSYTRNNTYVF

SEQ ID NO: 1510 - protein, 13 aa, synthetic construct [sequence omitted]

SEQ ID NO: 1511 - protein, 13 aa, synthetic construct [sequence omitted]

SEQ ID NO: 1512 - protein, 16 aa, synthetic construct
CCSYAGRSTLGIDWVF

SEQ ID NO: 1513 - protein, 13 aa, synthetic construct [sequence omitted]

SEQ ID NO: 1514 - protein, 13 aa, synthetic construct [sequence omitted]

SEQ ID NO: 1515 - protein, 12 aa, synthetic construct [sequence omitted]

SEQ ID NO: 1516 - protein, 12 aa, synthetic construct [sequence omitted]

SEQ ID NO: 1517 - protein, 12 aa, synthetic construct [sequence omitted]

SEQ ID NO: 1518 - protein, 12 aa, synthetic construct
CISYTNTNTRVF

SEQ ID NO: 1519 - protein, 12 aa, synthetic construct [sequence omitted]

SEQ ID NO: 1520 - protein, 12 aa, synthetic construct [sequence omitted]

SEQ ID NO: 1521 - protein, 13 aa, synthetic construct [sequence omitted]

SEQ ID NO: 1522 - protein, 13 aa, synthetic construct [sequence omitted]

SEQ ID NO: 1523 - protein, 11 aa, synthetic construct [sequence omitted]

SEQ ID NO: 1524 - protein, 11 aa, synthetic construct [sequence omitted]

SEQ ID NO: 1525 - protein, 13 aa, synthetic construct [sequence omitted]

SEQ ID NO: 1526 - protein, 13 aa, synthetic construct [sequence omitted]

SEQ ID NO: 1527 - protein, 12 aa, synthetic construct [sequence omitted]

SEQ ID NO: 1528 - protein, 13 aa, synthetic construct [sequence omitted]

SEQ ID NO: 1529 - protein, 11 aa, synthetic construct [sequence omitted]

SEQ ID NO: 1530 - protein, 11 aa, synthetic construct [sequence omitted]

SEQ ID NO: 1531 - protein, 11 aa, synthetic construct [sequence omitted]

SEQ ID NO: 1532 - protein, 12 aa, synthetic construct [sequence omitted]

SEQ ID NO: 1533 - protein, 13 aa, synthetic construct
CYSRDSSGSLWIF

SEQ ID NO: 1534 - protein, 13 aa, synthetic construct [sequence omitted]

SEQ ID NO: 1535 - protein, 13 aa, synthetic construct [sequence omitted]

SEQ ID NO: 1536 - protein, 13 aa, synthetic construct [sequence omitted]

SEQ ID NO: 1537 - protein, 13 aa, synthetic construct [sequence omitted]

SEQ ID NO: 1538 - protein, 13 aa, synthetic construct [sequence omitted]

SEQ ID NO: 1539 - protein, 13 aa, synthetic construct [sequence omitted]

SEQ ID NO: 1540 - protein, 12 aa, synthetic construct [sequence omitted]

SEQ ID NO: 1541 - protein, 12 aa, synthetic construct [sequence omitted]

SEQ ID NO: 1542 - protein, 12 aa, synthetic construct [sequence omitted]

SEQ ID NO: 1543 - protein, 12 aa, synthetic construct [sequence omitted]

SEQ ID NO: 1544 - protein, 11 aa, synthetic construct [sequence omitted]

SEQ ID NO: 1545 - protein, 11 aa, synthetic construct [sequence omitted]

SEQ ID NO: 1546 - protein, 11 aa, synthetic construct [sequence omitted]

SEQ ID NO: 1547 - protein, 12 aa, synthetic construct
CFSTDSSGNKVF

SEQ ID NO: 1548 - protein, 12 aa, synthetic construct [sequence omitted]

SEQ ID NO: 1549 - protein, 12 aa, synthetic construct [sequence omitted]

SEQ ID NO: 1550 - protein, 13 aa, synthetic construct [sequence omitted]

SEQ ID NO: 1551 - protein, 13 aa, synthetic construct
CNSRDSSYNHWVF

SEQ ID NO: 1552 - protein, 13 aa, synthetic construct [sequence omitted]

SEQ ID NO: 1553 - protein, 13 aa, synthetic construct [sequence omitted]

SEQ ID NO: 1554 - protein, 13 aa, synthetic construct [sequence omitted]

SEQ ID NO: 1555 - protein, 13 aa, synthetic construct [sequence omitted]

SEQ ID NO: 1556 - protein, 13 aa, synthetic construct [sequence omitted]

SEQ ID NO: 1557 - protein, 13 aa, synthetic construct [sequence omitted]

SEQ ID NO: 1558 - protein, 13 aa, synthetic construct [sequence omitted]

SEQ ID NO: 1559 - protein, 13 aa, synthetic construct
CAAWDARLNGWVF

SEQ ID NO: 1560 - protein, 12 aa, synthetic construct [sequence omitted]

SEQ ID NO: 1561 - protein, 13 aa, synthetic construct [sequence omitted]

SEQ ID NO: 1562 - protein, 13 aa, synthetic construct [sequence omitted]

SEQ ID NO: 1563 - protein, 13 aa, synthetic construct [sequence omitted]

SEQ ID NO: 1564 - protein, 11 aa, synthetic construct [sequence omitted]

SEQ ID NO: 1565 - protein, 12 aa, synthetic construct [sequence omitted]

SEQ ID NO: 1566 - protein, 11 aa, synthetic construct [sequence omitted]

SEQ ID NO: 1567 - protein, 13 aa, synthetic construct [sequence omitted]

SEQ ID NO: 1568 - protein, 11 aa, synthetic construct [sequence omitted]

SEQ ID NO: 1569 - protein, 11 aa, synthetic construct [sequence omitted]

SEQ ID NO: 1570 - protein, 13 aa, synthetic construct [sequence omitted]

SEQ ID NO: 1571 - protein, 13 aa, synthetic construct [sequence omitted]

SEQ ID NO: 1572 - protein, 13 aa, synthetic construct [sequence omitted]

SEQ ID NO: 1573 - protein, 13 aa, synthetic construct [sequence omitted]

SEQ ID NO: 1574 - protein, 13 aa, synthetic construct [sequence omitted]

SEQ ID NO: 1575 - protein, 11 aa, synthetic construct [sequence omitted]

SEQ ID NO: 1576 - protein, 11 aa, synthetic construct [sequence omitted]

SEQ ID NO: 1577 - protein, 13 aa, synthetic construct [sequence omitted]

SEQ ID NO: 1578 - protein, 13 aa, synthetic construct [sequence omitted]

SEQ ID NO: 1579 - protein, 13 aa, synthetic construct [sequence omitted]

SEQ ID NO: 1580 - protein, 13 aa, synthetic construct [sequence omitted]

SEQ ID NO: 1581 - protein, 12 aa, synthetic construct [sequence omitted]

SEQ ID NO: 1582 - protein, 12 aa, synthetic construct [sequence omitted]

SEQ ID NO: 1583 - protein, 13 aa, synthetic construct [sequence omitted]

SEQ ID NO: 1584 - protein, 11 aa, synthetic construct [sequence omitted]

SEQ ID NO: 1585 - protein, 11 aa, synthetic construct [sequence omitted]

SEQ ID NO: 1586 - protein, 11 aa, synthetic construct [sequence omitted]

SEQ ID NO: 1587 - protein, 11 aa, synthetic construct [sequence omitted]

SEQ ID NO: 1588 - protein, 13 aa, synthetic construct [sequence omitted]

SEQ ID NO: 1589 - protein, 13 aa, synthetic construct [sequence omitted]

SEQ ID NO: 1590 - protein, 11 aa, synthetic construct [sequence omitted]

SEQ ID NO: 1591 - protein, 11 aa, synthetic construct [sequence omitted]

SEQ ID NO: 1592 - protein, 12 aa, synthetic construct [sequence omitted]

SEQ ID NO: 1593 - protein, 11 aa, synthetic construct
CFSAADNTSVF

SEQ ID NO: 1594 - protein, 13 aa, synthetic construct [sequence omitted]

SEQ ID NO: 1595 - protein, 13 aa, synthetic construct [sequence omitted]

SEQ ID NO: 1596 - protein, 12 aa, synthetic construct [sequence omitted]

SEQ ID NO: 1597 - protein, 13 aa, synthetic construct
CTSWDDSLNTWVF

SEQ ID NO: 1598 - protein, 11 aa, synthetic construct [sequence omitted]

SEQ ID NO: 1599 - protein, 13 aa, synthetic construct [sequence omitted]

SEQ ID NO: 1600 - protein, 13 aa, synthetic construct [sequence omitted]

SEQ ID NO: 1601 - protein, 12 aa, synthetic construct [sequence omitted]

SEQ ID NO: 1602 - protein, 12 aa, synthetic construct [sequence omitted]

SEQ ID NO: 1603 - protein, 116 aa, synthetic construct
QVQLVQSGAEVKKPGASVKVSCKASGYTFTSYDINWVRQATGQGLEWMGWMNPNSGNTGYAQKFQGRVTMTRNTSISTAYMELSSLRSEDTAVYYCARWGRGFDPWGQGTLVTVSS

SEQ ID NO: 1604 - protein, 119 aa, synthetic construct
QVQLVQSGAEVKKPGSSVKVSCKASGGTFSSYAISWVRQAPGQGLEWMGGIIPIFGTANYAQKFQGRVTITADESTSTAYMELSSLRSEDTAVYYCARERLELRWFDPWGQGTLVTVSS

SEQ ID NO: 1605 - protein, 118 aa, synthetic construct
QLQLQESGPGLVKPSETLSLTCTVSGGSISSSSYYWGWIRQPPGKGLEWIGSIYYSGSTYYNPSLKSRVTISVDTSKNQFSLKLSSVTAADTAVYYCARQTDYWFDPWGQGTLVTVSS

SEQ ID NO: 1606 - protein, 120 aa, synthetic construct
EVQLVESGGGLVRPGGSLRLSCAASGFTFSSYSIHWVRQAPGKGLEWVSSISSSSTYIYYADSLKGRFTISRDNAKNSLYLQMNSLRAEDTAVYYCAREGGIAVAGFDYWGQGTLVTVSS

SEQ ID NO: 1607 - protein, 120 aa, synthetic construct
EVQLVESGGGLVQPGGSLRLSCAASGFTFSSYDMHWVRQATGKGLEWVSAIGTAGDTYYPGSVKGRFTISRENAKNSLYLQMNSLRAGDTAVYYCARDSSSWYEDAFDIWGQGTMVTVSS

SEQ ID NO: 1608 - protein, 120 aa, synthetic construct
EVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCAREETMVRGVIAYWGQGTLVTVSS

SEQ ID NO: 1609 - protein, 116 aa, synthetic construct
EVQLVESGGGLVKPGGSLRLSCAVSGFTFSTDSMNWVRQAPGKGLEWVSSISGSSSYIYYTDSVKGRFTISRDNAKNSLFLQMNSLRAEDTAVYYCARDWGSFDLWGRGTLVTVSS

SEQ ID NO: 1610 - protein, 121 aa, synthetic construct
EVQLVESGGGLIQPGGSLRLSCAASGFTVSSNYMSWVRQAPGKGLEWVSVIYSGGSTYYADSVKGRFTISRDNSKNTLYLQMNSLRAEDTAVYYCARDGGEYSSSYYFDYWGQGTLVTVSS

SEQ ID NO: 1611 - protein, 117 aa, synthetic construct
QLQLQESGPGLVKPSETLSLTCTVSGGSISSSSYYWGWIRQPPGKGLEWIGSIYYSGSTYYNPSLKSRVTISVDTSKNQFSLKLSSVTAADTAVYYCARHDPSFDYWGQGTLVTVSS

SEQ ID NO: 1612 - protein, 118 aa, synthetic construct
QVQLVQSGAEVKKPGASVKVSCKASGYTFTSYGISWVRQAPGQGLEWMGWISAYNGNTNYAQKLQGRVTMTTDTSTSTAYMELRSLRSDDTAVYYCARERSNWDFDYWGQGTLVTVSS

SEQ ID NO: 1613 - protein, 122 aa, synthetic construct
EVQLVESGGGLVQPGGSLRLSCAASGFTFSSYWMSWVRQAPGKGLEWVANIKQDGSEKYYVDSVKGRFTISRDNAKNSLYLQMNSLRAEDTAVYYCARDGGVRGVITYFDYWGQGTLVTVSS

SEQ ID NO: 1614 - protein, 121 aa, synthetic construct
QVQLVQSGAEVKKPGASVKVSCKASGYTFTSYDINWVRQATGQGLEWMGWMNPNSGNTGYAQKFQGRVTMTRNTSISTAYMELSSLRSEDTAVYYCARGRGSSWYWYFDLWGRGTLVTVSS

SEQ ID NO: 1615 - protein, 117 aa, synthetic construct
EVQLVESGGGLVQPGGSLRLSCAASGFTFSSYDMHWVRQATGKGLEWVSAIGTAGDTYYPGSVKGRFTISRENAKNSLYLQMNSLRAGDTAVYYCARGSSSSAFDIWGQGTMVTVSS

SEQ ID NO: 1616 - protein, 120 aa, synthetic construct
EVQLVESGGGLVKPGGSLRLSCAASGFTFSSYSMNWVRQAPGKGLEWVSSISSSSSYIYYADSVKGRFTISRDNAKNSLYLQMNSLRAEDTAVYYCARDGGIAAAGTDYWGQGTLVTVSS

SEQ ID NO: 1617 - protein, 120 aa, synthetic construct
EVQLVESGGGLVKPGGSLRLSCAASGFTFSSYSMNWVRQAPGKGLEWVSSISSSSSYIYYADSVKGRFTISRDNAKNSLYLQMNSLRAEDTAVYYCARADSLTGGFFDYWGQGTLVTVSS

SEQ ID NO: 1618 - protein, 116 aa, synthetic construct
QVQLVQSESELKKPGASVKVSCKASGYTFISYAMSWVRQAPGQGLEWMGWINTNTGNPTYAQGFTGRFVFSLDTSVSTAYLQISSLKAEDTAVYYCAERGWNYDYWGQGTLVTVSS

SEQ ID NO: 1619 - protein, 118 aa, synthetic construct
EVQLVESGGGLIQPGGSLRLSCAASGFTVSSNYMSWVRQAPGKGLEWVSVIYSGGSTYYADSVKGRFTISRDNSKNTLYLQMNSLRAEDTAVYYCARDSTTVTLFDYWGQGTLVTVSS

SEQ ID NO: 1620 - protein, 121 aa, synthetic construct
EVQLVESGGGLVKPGGSLRLSCAASGFTFSSYSMNWVRQAPGKGLEWVSSISSSSSYIYYADSVKGRFTISRDNAKNSLYLQMNSLRAEDTAVYYCARGIAVAGPHAFDIWGQGTMVTVSS

SEQ ID NO: 1621 - protein, 116 aa, synthetic construct
EVQLVESGGGLIQPGGSLRLSCAASGFTVSSNYMSWVRQAPGKGLEWVSVIYSGGSTYYADSVKGRFTISRDNSKNTLYLQMNSLRAEDTAVYYCARGYSGSYAYWGQGTLVTVSS

SEQ ID NO: 1622 - protein, 122 aa, synthetic construct
QVQLQQSGPGLVKPSQTLSLTCAISGDSVSSNSAAWNWIRQSPSRGLEWLGRTYYRSKWYNDYAGSVKSRIIINPDTSKNQLSLQLKSVTPEDTAVYYCARKWELRDAFDIWGQGTMVTVSS

SEQ ID NO: 1623 - protein, 121 aa, synthetic construct
EVQLVQSGAVVKKPGESLKISCKGSGYSFSSYWIGWVRQMPGKGLEWMGIIYPGDSDTRYSPSFQGQVTISADKSISTAYLQWSSLQASDTAMYFCAKRRMTGSHSWFDPWGQGTLVTVSS

SEQ ID NO: 1624 - protein, 112 aa, synthetic construct
EVQLVESGGGLVQPGGSLRLSCAASGFTFSSYWMHWVRQAPGKGLVWVSRINSDGSSTSYADSVKGRFTISRDNAKNTLYLQMNSLRAEDTAVYYCARIDYWGQGTLVTVSS

SEQ ID NO: 1625 - protein, 113 aa, synthetic construct
EVQLVESGGGLVQPGGSLRLSCAASGFTFSSYWMSWVRQAPGKGLEWVANIKQDGSEKYYVDSVKGRFTISRDNAKNSLYLQMNSLRAEDTAVYYCARDGGTPGQGTLVTVSS

SEQ ID NO: 1626 - protein, 115 aa, synthetic construct
QVQLQESGPGLVKPSETLSLTCTVSGGSISSYYWSWIRQPPGKGLEWIGYIYYSGSTNYNPSLKSRVTISVDTSKNQFSLKLSSVTAADTAVYYCAIVGARFDYWGQGTLVTVSS

SEQ ID NO: 1627 - protein, 115 aa, synthetic construct
EVQLVESGGGLVKPGGSLRLSCAASGFTFINAWMSWVRQAPGKGLEWVGRIKSKTDGGTTDYAAPVKGRFTISRDDSKNTLYLQMNSLKTEDTAVYYCTTGGTHWGQGTLVTVSS

SEQ ID NO: 1628 - protein, 115 aa, synthetic construct
EVQLVESGGGLVKPGGSLRLSCAASGFTFSNAWMSWVRQAPGKGLEWVGRIKSKTDGGTTDYAAPVKGRFTISRDDSKNTLYLQMNSLKTEDTAVYYCTTGGYRWGQGTLVTVSS

SEQ ID NO: 1629 - protein, 115 aa, synthetic construct
EVQLVESGGGLVKPGGSLRLSCAASGFTFSNAWMSWVRQAPGKGLEWVGRIKSKTDGGTTDYAAPVKGRFTISRDDSKNTLYLQMNSLKTEDTAVYYCTTDLYYWGQGTLVTVSS

SEQ ID NO: 1630 - protein, 115 aa, synthetic construct
QVQLVQSGAEVKKPGASVKVSCKASGYTFTSYGISWVRQAPGQGLEWMGWISAYNGNTNYAQKLQGRVTMTTDTSTSTAYMELRSLRSDDTAVYYCARGWYFDYWGQGTLVTVSS

SEQ ID NO: 1631 - protein, 115 aa, synthetic construct
EVQLVESGGGLVQPGGSLRLSCAASGFTFSTYAMNWVRQAPGKGLEWVSAISGGGGSTYYADSVKGRFTISRDNSKNTLYLQMNSLRAEDTAVYYCAKRVFFDYWGQGTLVTVSS

SEQ ID NO: 1632 - protein, 116 aa, synthetic construct
EVQLVESGGGLVQPGGSLRLSCAASGFTFSSYDMHWVRQATGKGLEWVSAIGTAGDTYYPGSVKGRFTISRENAKNSLYLQMNSLRAGDTAVYYCARDLGRVFDYWGQGTLVTVSS

SEQ ID NO: 1633 - protein, 116 aa, synthetic construct
VVQLVESGGGLVQPGGSLRLSCAASGFTFSRYWMSWVRQAPGKGLEWVANINQDGSEEYYVDSVKGRFTISRDNAKSSLSLQMNSLRAEDTALYYCATDLNWNGYWGQGTLVTVSS

SEQ ID NO: 1634 - protein, 116 aa, synthetic construct
EVQLVESGGGLVQPGGSLRLSCAASGFTFSRCDMYWVRQATGKGLEWVSAIGAAGDTYYPGSVKGRFTISRENAKNSLYLQMNSLRAGDTAVYYCATGYNWNPDYWGQGTLVTVSS

SEQ ID NO: 1635 - protein, 117 aa, synthetic construct
QVQLVESGGGVVQPGRSLRLSCEASGFTFINYGMHWVRQAPGKGLEWVAVIWYDGSNKYYADSVKGRFTISRDNSKNTLYLQMNSLRAEDTAVYYCARDRSSSSDYWGQGTLVIVSS

SEQ ID NO: 1636 - protein, 117 aa, synthetic construct
EVQLVESGGGLVQPGGSLRLSCAASGFTFSSYWMHWVRQAPGKGLVWVSRINSDGSSTSYADSVKGRFTISRDNAKNTLYLQMNSLRAEDTAVYYCAGITGTYFDYWGQGTLVTVSS

SEQ ID NO: 1637 - protein, 117 aa, synthetic construct
EVQLVESGGGLVQPGRSLRLSCAASGFTFDDYAMHWVRQAPGKGLEWVSGISWNSGSIGYADSVKGRFTISRDNAKNSLYLQMNSLRAEDTALYYCAKDSGYSPDYWGQGTLVTVSS

SEQ ID NO: 1638 - protein, 117 aa, synthetic construct
QVQLVQSGAEVKKPGASVKVSCKASGYTFTSYGISWVRQAPGQGLEWMGWISAYNGNTNYAQKLQGRVTMTTDTSTSTAYMELRSLRSDDTAVYYCARDRPYYFDYWGQGTLVTVSS

SEQ ID NO: 1639 - protein, 117 aa, synthetic construct
QVQVVQSGAEVRKSGASVKVSCKASGYTFTSYYIHWVRQVPGQGLEWMGLINPSGGSTIYAQKFQGRVTMTRDTSTSSVYMELSSLRSEDTAAYYCARGGWGTMDVWGKGTTVTVSS

SEQ ID NO: 1640 - protein, 117 aa, synthetic construct
EVQLVESGGGLVQPGGSLRLSCAASGFTFSSYDMHWVRQATGKGLEWVSAIGTAGDTYYPGSVKGRFTISRENAKNSLYLQMNSLRAGDTAVYYCARAWELDAFDIWGQGTMVTVSS

SEQ ID NO: 1641 - protein, 117 aa, synthetic construct
EVQLVESGGGLVQPGGSLRLSCAASGFTFSSYAMSWVRQAPGKGLEWVSAISGSGGSTYYADSVKGRFTISRDNSKNTLYLQMNSLRAEDTAVYYCAKDNWNYFDYWGQGTLVTVSS

SEQ ID NO: 1642 - protein, 117 aa, synthetic construct
QVQLVESGGGVVQPGRSLRLSCAASGFTFSSYGMHWVRQAPGKGLEWVAVIWYDGSNKYYADSVKGRFTISRDNSKNTLYLQMNSLRAEDTAVYYCARVYNWIFDYWGQGTLVTVSS

SEQ ID NO: 1643 - protein, 117 aa, synthetic construct
EVQVMESGGGLVKPGGSLRLSCAASGFSFSSHSLNWVRQAPGKGLEWVSSISGISNYIAYADSVRGRFTISRDNAKNSLFLQMNSLRAEDTGVYYCARITVVSFDYWGQGTLVTVTS

SEQ ID NO: 1644 - protein, 117 aa, synthetic construct
EVQLVESGGGLVQPGGSLRLSCAASGFTFSSYAMSWVRQAPGKGLEWVSAISGSGGNTYNADSVKGRFTISRDNSKNTLYLQMNSLRAEDTAVYYCAKAAAGKGDYWGQGTLVTVSS

SEQ ID NO: 1645 - protein, 117 aa, synthetic construct
QVQLVQSGAEVKKPGASVKVSCKASGYTFTSYYIHWVRQAPGQGLEWMGIINPSGGTTNYAQKFQGRVTMTRDTSTSTVYMELSSLRSEDTAVYYCARGDWGTMDVWGKGTTVTVSS

SEQ ID NO: 1646 - protein, 117 aa, synthetic construct
EVQLVESGGGLVQPGGSLRLSCAASGFTFSSYWMSWVRQAPGKGLEWVANIKQDGSEKYYVDSVKGRFTISRDNAKNSLYLQMNSLRAEDTAVYYCARDGTGWFDPWGQGTLVTVSS

SEQ ID NO: 1647 - protein, 117 aa, synthetic construct
QVQLVQSGAEVKKPGASVKVSCKASGYTFTSYGISWVRQAPGQGLEWMGWISAYNGNTNYAQKLQGRVTMTTDTSTSTAYMELRSLRSDDTAVYYCARRGTVVFDYWGQGTLVTVSS

SEQ ID NO: 1648 - protein, 117 aa, synthetic construct
QVQLVQSGAEVKKPGASVKVSCKASGYTFTNYGISWVRQAPGQGLEWMGWISAYNGNTNYAQNLQGRVTMTTDTSTSTAYMELRSLRSDDTAVYYCARPLSGTLDNWGQGTLVTVSS

SEQ ID NO: 1649 - protein, 118 aa, synthetic construct
EVQLVESGGGLVQPGGSLRLSCAASGFTFSSYSMNWVRQAPGKGLEWVSYISSSSSTIYYADSVKGRFTISRDNAKNSLYLQMNSPRDEDTAVYYCARESIAALFDYWGQGTLVTVSS

SEQ ID NO: 1650 - protein, 118 aa, synthetic construct
EVQLVESGGGLVQPGGSLRLSCAASGFTFSSYDMHWVRQATGKGLEWVSAIGTAGDTYYPGSVKGRFTISRENAKNSLYLQMNSLRAGDTAVYYCARGDHSYGGLDYWGQGTLVTVSS

SEQ ID NO: 1651 - protein, 118 aa, synthetic construct
QVQLVQSGAEVEKPGASVKVSCKASGYTFTSYDIYWVRQATGQGLEWMGWMIPNSGNTGYAQRFEDRVTMTRSTSMNTAYMELNSLRSEDTAVYYCARGDWAWSFDLWGRGTLVTVSS

SEQ ID NO: 1652 - protein, 118 aa, synthetic construct
QVQLVQSGAEVKKPGASVKVSCKASGYTFTSYYMHWVRQAPGQGLEWMGIINPSGGSTSYAQKFQGRVTMTRDTSTSTVYMELSSLRSEDTAVYYCARGLRRDWFDPWGQGTLVTVSS

SEQ ID NO: 1653 - protein, 118 aa, synthetic construct
EVQLVESGGGLVKPGGSLRLSCAASGFTFSNAWMSWVRQAPGKGLEWVGRIKSKTDGGTTDYAAPVKGRFTISRDDSKNTLYLQMNSLKTEDTAVYYCTTGTGRSDYWGQGTLVTVSS

SEQ ID NO: 1654 - protein, 118 aa, synthetic construct
QVQLVESGGGVVQPGRSLRLSCAASGFTFSNYGMHWVRQAPGKGLDWVAVIWYDGNNEYYADSVKDRFTISRDNSQNTLYLQMNSLRAEDRAVYYCVRGGVGDGFDMWGQGTMVTVSS

SEQ ID NO: 1655 - protein, 118 aa, synthetic construct
QVQLVESGGGVVQPGRSLRLSCAASGFTFSSYGMHWVRQAPGKGLEWVAVIWYDGSNKYYADSVKGRFTISRDNSKNTLYLQMNSLRAEDTAVYYCASVGSYGYFQHWGQGTLVTVSS

SEQ ID NO: 1656 - protein, 118 aa, synthetic construct
EVQLVESGGGVVRPGGSLRLSCAASGFTFDDYGMSWVRQAPGKGLEWVSGINWNGGSTGYADSVKGRFTISRDNAKNSLYLQMNSLRAEDTALYYCARKGNWNSFDYWGQGTLVTVSS

SEQ ID NO: 1657 - protein, 118 aa, synthetic construct
EVQLVESGGGLVKPGGSLRLSCAASGFTFSSYSMNWVRQAPGKGLEWVSSISSSSSYIYYADSVKGRFTISRDNAKNSLYLQMNSLRAEDTAVYYCARDSAYYTFDYWGQGTLVTVSS

SEQ ID NO: 1658 - protein, 118 aa, synthetic construct
EVQLVESGGGLVQPGGSLRLSCAASGFTFSSYAMSWVRQAPGKGLEWVSAISGSGGSTYYADSVKGRFTISRDNSKNTLYLQMNSLRAEDTAVYYCGSGWYEGAFDYWGQGTLVTVSS

SEQ ID NO: 1659 - protein, 119 aa, synthetic construct
EVQLVESGGGLVQPGGSLRLSCAASGFTFSSYDMHWVRQATGKGLEWVSAIGTAGDTYYPGSVKGRFTISRENAKNSLYLQMNSLRAGDTAVYYCARDRDSSHDAFDIWGQGTMVTVSS

SEQ ID NO: 1660 - protein, 119 aa, synthetic construct
EVQLVESGGGVVRPGGSLRLSCAASGFPFDDFGLNWVRQAPGKGLEWVSGINWNGGTTTYADSVKGRFTISRDNAKKSLYLQMSSLRVEDTALFYCVRDEIWNYYFDYWGQGTLVTVSS

SEQ ID NO: 1661 - protein, 119 aa, synthetic construct
EVQMVESGGGRVKPGGSLRLSCTASGFSISINNMNWVRQAPGKGLEWVSSISSSSTYIYYADSVKGRFTISRDNAENSLYLQMNSLRAEDTGVYYCARDSYDFHAFDIWGQGTMVTVSS

SEQ ID NO: 1662 - protein, 119 aa, synthetic construct
EVQLVESGGGLVQPGGSLRLSCAASGFTFSSYWMHWVRQAPGKGLVWVSRINSDGSSTSYADSVKGRFTISRDNAKNTLYLQMNSLRAEDTAVYYCARVGWGGHAFDIWGQGTMVTVSS

SEQ ID NO: 1663 - protein, 119 aa, synthetic construct
EVQLVESGGGLVKPGGSLRLSCAASGFTFSTYSMNWVRQAPGKGLEWVSSISSSSTYIYYADSVKGRFTISRDNAKNSLYLQMNSLRAEDTAVYYCARGYNWNYVGDYWGQGTLVTVSS

SEQ ID NO: 1664 - protein, 119 aa, synthetic construct
EVQLVESGGGLVQPGGSLRLSCAASGFTFSSYAMSWVRQAPGKGLEWVSAISGSGGSTYYADSVKGRFTISRDNSKNTLYLQMNSLRAEDTAVYYCAKDANWGYAFDIWGQGTMVTVSS

SEQ ID NO: 1665 - protein, 120 aa, synthetic construct
QVQLVQSVSEVNKPGASVKVSCKASGYTFTTYGISWVRQAPGQGLEWMGWISGYSGYTSYAQKFQGRLTMTTDTSANTAYMELRSLRSDDTAVYYCARRFIWNYGDFDYWGQGTLVTVSS

SEQ ID NO: 1666 - protein, 120 aa, synthetic construct
EVQLVESGGDLVQPGGSLRLSCAASGFTFSSYSMNWVRQAPGKGLEWVSYISRSSGTIYYADSVKGRFTISRDNAKNSLYLQMNSLRDEDTAVYYCARGRLGIEDYFDYWGQGTLVTVSS

SEQ ID NO: 1667 - protein, 120 aa, synthetic construct
EVQLVESGGGLVQPGGSLRLSCAASGFTFNRYNMNWVRQAPGKGLEWVSYISSSSDTIYYADSVKGRFTISRDNAKNSLYLQMNSLRDEDTAMYYCARECYSSSWAFDYWGQGTLVTVSS

SEQ ID NO: 1668 - protein, 120 aa, synthetic construct
QVQLQESGPGLVKPSGTLSLTCAISGGSISSSNWWSWVRQPPGKGLEWIGEIYHSGSTNFNPSLKSRVTISVDKSKNQFSLHLSSVTAADTAVYYCARDVGVDGRGFDYWGQGIVVIVSS

SEQ ID NO: 1669 - protein, 120 aa, synthetic construct
EVQLVESGGGLVQPGGSLRLSCGVSGFTFSIYWMSWVRQAPGKGLEWVANINLDGSEKYHVDSVKGRFTISRDNAKNSLFLQMTSLRAEDTAVYYCARDILWSGGYLDVWGKGTTVTVSS

SEQ ID NO: 1670 - protein, 120 aa, synthetic construct
EVQLVESGGGLVQPGGSLRLSCAASGFTFSGYWMTWVRQAPGKGLEWVANIKHDGSEKYYVDSVKGRFTISRDNAQNSLYLQMNSLRAEDTAVYYCARKQLWLNWYFDFWGRGILVTVSS

SEQ ID NO: 1671 - protein, 120 aa, synthetic construct
QVQLVQSGAEVKKPGASVKVSCKASGYTFTTYGISWVRQAPGQGLEWMGWISAFNGNTNYAQNLQGRVTMTTDTSTSTAYMELRSLRSDDTAVYYCARENNWNYGWFDPWGQGTLVTVSS

SEQ ID NO: 1672 - protein, 120 aa, synthetic construct
EVQLVESGGGLVQPGGSLRLSCAASGFTFSSYDMHWVRQATGKGLEWVSAIGTAGDTYYPGSVKGRFTISRENAKNSLYLQMNSLRAGDTAVYYCAREGYGDYPLPMDVWGKGTTVTVSS

SEQ ID NO: 1673 - protein, 120 aa, synthetic construct
EVQLVESGGGLVKPGGSLRLSCAASGFTFSNAWMSWVRQAPGKGLEWVGRIKSKTDGGTTDYAAPVKGRFTISRDDSKNTLYLQMNSLKTEDTAVYYCTTDNWNSYFDYWGQGTLVTVSS

SEQ ID NO: 1674 - protein, 120 aa, synthetic construct
EVQLVESGGGLVQPGGSLRLSCAASGFTFSSYAMSWVRQAPGKGLEWVSAISGGGGSTYYADSVKGRFTISRDNSKNTLYLQMNSLRAEDTAVYYCAGNSGYDSPYFDYWGQGTLVTVSS

SEQ ID NO: 1675 - protein, 120 aa, synthetic construct
QVQLVESGGGVVQPGRSLRLSCAASGFTFSSYGMHWVRQAPGKGLEWVAVIWYDGSNKYYADSVKGRFTISRDNSKNTLYLQMNSLRAEDTAVYYCAREYSSSSDWFDPWGQGTLVTVSS

SEQ ID NO: 1676 - protein, 120 aa, synthetic construct
EVQLVESGGGLVKPGGSLRLSCAASGFTFSSYSMNWVRQAPGKGLEWVSSISSSSSYIYYADSVKGRFTISRDNAKNSLYLQMNSLRAEDTAVYYCARDGGITGRYFDLWGRGTLVTVSS

SEQ ID NO: 1677 - protein, 120 aa, synthetic construct
EVQLVESGGGLVKPGGSLRLSCAASGFTFSSYSMNWVRQAPGKGLEWVSSISSSSSYIYYADSVKGRFTISRDNAKNSLYLQMNSLRAEDTAVYYCAREGNWGPYYFDYWGQGTLVTVSS

SEQ ID NO: 1678 - protein, 120 aa, synthetic construct
QVQLVQSGAEVKKPGASVKVSCKASGYTFTGYYMHWVRQAPGQGLEWMGWINPNSGGTNYAQKFQGRVTMTRDTSISTAYMELSRLRSDDTAVYYCARGVWSGYYTFDPWGQGTLVTVSS

SEQ ID NO: 1679 - protein, 120 aa, synthetic construct
EVQLVESGGGLVKPGGSLRLSCAASGFTFSNAWMSWVRQAPGKGLEWVGRIKSKTDGGTTDYAAPVKGRFTISRDDSKNTLYLQMNSLKTEDTAVYYCTPHSSSPVFDYWGQGTLVTVSS

SEQ ID NO: 1680 - protein, 121 aa, synthetic construct
QVQLVQSGAEVKKPGASVKVSCKASGYTFTGYYMHWVRQAPGQGLEWMGWINPNSGGTNYAQKFQGRVTMTRDTSISTAYMELSRLRSDDTAVYYCARDDTGTTGGYFQHWGQGTLVTVSS

SEQ ID NO: 1681 - protein, 121 aa, synthetic construct
QVQLVQSGAEVKKPGASVKVSCKASGYTFTSYDINWVRQATGQGLEWMGWMNPNSGNTGYAQKFQGRVTMTRNTSISTAYMELSSLRSEDTAVYYCARAVAVAGTGWFDPWGQGTLVTVSS

SEQ ID NO: 1682 - protein, 121 aa, synthetic construct
EVQLVESGGGLVKPGGSLRLSCAASGFTFSNAWMSWVRQAPGKGLEWVGRIKSKTDGGTTDYAAPVKGRFTISRDDSKNTLYLQMNSLKTEDTAVYYCTTNYGDYVGFDYWGQGTLVTVSS

SEQ ID NO: 1683 - protein, 121 aa, synthetic construct
EVHLVESGGGLVQPGGSLRLSCAASGFTFSGYWMSWVRQAPGKGLEWVANIKQDGSDKYYVDSVKGRFTISRDNAINSLFLQLTSLRAEDTAVYYCAREIDWNYGFHFDYWGQGTLITVSS

SEQ ID NO: 1684 - protein, 121 aa, synthetic construct
QVQLVQSGAEVKKPGASVKVSCKASGYTFTSYDINWVRQATGQGLEWMGWMNPNSGNTGYAQKFQGRVTMTRNTSISTAYMELSSLRSEDTAVYYCARGYYDFWSGPFDYWGQGTLVTVSS

SEQ ID NO: 1685 - protein, 121 aa, synthetic construct
QVQLVESGGGVVQPGRSLRLSCAASGFTFSSYGMHWVRQAPGKGLEWVAVIWYDGSNKYYADSVKGRFTISRDNSKNTLYLQMNSLRAEDTAVYYCARDSKWELLNWFDPWGQGTLVTVSS

SEQ ID NO: 1686 - protein, 121 aa, synthetic construct
QVQLQESGPGLVKPSETLSLTCTVSGGSISDYYWNWIRQPPGKGLEWIGYISSRGRTNYNPSLKSRVTLSVDSSKNQFSLKLTSVTAADTAVFYCARGRHFDWLLSYFDYWGQGTLVTVSS

SEQ ID NO: 1687 - protein, 121 aa, synthetic construct
EVQLVESGGGLVKPGGSLRLSCAASGFTFSSDNMNWVRQAPGKGLEWVSSIGSSSSYIYYADSVKGRFTISRDNAKNSLYLQMNSLRAEDTAVYYCARDRAIVGATWFDPWGQGTLVIVSS

SEQ ID NO: 1688 - protein, 121 aa, synthetic construct
EVQLVESGGGLVKPGGSLRLSCAASGFTFSSYSMNWVRQAPGKGLEWVSSISSSSSYIYYADSVKGRFTISRDNAKNSLYLQMNSLRAEDTAVYYCARDRYNWNYRYFDLWGRGTLVTVSS

SEQ ID NO: 1689 - protein, 121 aa, synthetic construct
EVQLVESGGGLVKPGGSLRLSCAASGFTFSSYSMNWVRQAPGKGLEWVSSISSSSSYIYYADSVKGRFTISRDNAKNSLYLQMNSLRAEDTAVYYCARDSHDYGDSYFDYWGQGTLVTVSS

SEQ ID NO: 1690 - protein, 121 aa, synthetic construct
QVQLVQSGAEVKKPGASVKVSCKASGYTFTSYGISWVRQAPGQGLEWMGWISAYNGNTNYAQKLQGRVTMTTDTSTSTAYMELRSLRSDDTAVYYCARDGAARPPRYMDVWGKGTTVTVSS

SEQ ID NO: 1691 - protein, 121 aa, synthetic construct
QVQLVQSGAEVRKPVASVKVSCKASGYTFTDHSIHWVRQAPGQGLEWMGSINPNSGGTNYAQKFQGRVTMTRDTYNCTAYMELSRLRSDDTAVYYCARSDSGSHYVFFDDWGQGTLVTVSS

SEQ ID NO: 1692 - protein, 121 aa, synthetic construct
QVQLVQSGSEVKKPGASVKVSCKASGYTFTGYYMYWVRQAPGQGLEWMGWINPNSGGTNYAQKFQDRVTMTRDTSISTAYMELSRLRSDDTAIYYCARDLDYYGSGNYDYWGQGTLVTVSS

SEQ ID NO: 1693 - protein, 121 aa, synthetic construct
EVQLVESGGGLVQPGGSLRLSCAASGFTFSSYWMHWVRQAPGKGLVWVSRVNSDGSNTTYADSVKGRFTISRDNAKNTLYLQMNSLRAEDTAVYYCARNRDYHGSGSFDYWGQGTLVTVSS

SEQ ID NO: 1694 - protein, 120 aa, synthetic construct
QVQLQQSGPGLVKPSQTLSLTCAISGDNVSSNSAAWNWIRQSPSRGLEWLGRTYYRSKWYNDYAVSVKSRITINPDTSKNQFSLHLNSVTPEDTALYYCARDWNFAFDIWGQGTMVTVSS

SEQ ID NO: 1695 - protein, 121 aa, synthetic construct
QVQLVQSGAEVKKPGASVKVSCKASGYTFTSYGITWVRQAPGQGLEWMGWISAYNGNTHYAQKLQGRVTMTTDTSTSTAYMDLRSLRSDDTAVYYCARTIFGVVNNWFDPWGQGTLVTVSS

SEQ ID NO: 1696 - protein, 121 aa, synthetic construct
QVQLVQSGAEVKKPGASVKVSCKASGYTFTGYYMHWVRQAPGQGLEWMGWINPNSGGTNYAQKFQGRVTMTRDTSISTAYMELSRLRSDDTAVYYCARDGEQLALNWFDPWGQGTLVTVSS

SEQ ID NO: 1697 - protein, 121 aa, synthetic construct
EVQLVESGGGLVKPGGSLRLSCAASGFTFSRYSMNWVRQAPGKGLEWVSSIISSTSYIYYADSVKGRFTISRDNAKNSLYLQMNSLRAEDTAVYYCARETPVTLFDAFDIWGQGTMVTVSS

SEQ ID NO: 1698 - protein, 121 aa, synthetic construct
EVHLVESGGGLVQPGRSLRLSCAASGFTFDEYAMHWVRQVPGKGLEWVSGISWNSGSIGYADSVKGRFTISRDNAKNSLYLQMNSLRAEDTALYYCAKDIFTGRAGYFDYWGQGTLVTVSS

SEQ ID NO: 1699 - protein, 121 aa, synthetic construct
QVQLVESGGGVVQPGRSLRLSCAASGFTFSSYGMHWVRQAPGKGLEWVAVIWYDGSNKYYADSVKGRFTISRDNSKNTLYLQMNSLRAEDTAVYYCARAITGTTGNWFDPWGQGTLVTVSS

SEQ ID NO: 1700 - protein, 121 aa, synthetic construct
QITLKESGPTLVKPTQTLTLTCTFSGFSISTSGVGVGWIRQPPGKALEWLAFIFWNDDKRYSPSLKSRLTITKDTSKNQVVLTMTNMDPVDTATYYCTHTEYGSSWSVDYWGQGTLVTVSS

SEQ ID NO: 1701 - protein, 121 aa, synthetic construct
EVQLVESGGGVVRPGGSLRLSCAASGFTFDDYGMSWVRQAPGKGLEWVSGINWNGGSTGYADSVKGRFTISRDNAKNSLYLQMNSLRAEDTALYYCARHFDWLLSNAFDIWGQGTMVTVSS

SEQ ID NO: 1702 - protein, 122 aa, synthetic construct
QVQLVQSGAEVKKPGASVKVSCKASGYTFTSYDINWVRQATGQGLEWMGWMNPNSGNTGYAQKFQGRVTMTRNTSISTAYMELSSLRSEDTAVYYCVRRITVVRGVISLDYWGQGTLVTVSS

SEQ ID NO: 1703 - protein, 122 aa, synthetic construct
EVQLVESGGGLVKPGGSLRLSCAASGFTFSSYSMNWVRQAPGKGLEWVSSISSSSSYIYYADSVKGRFTISRDNAKNSLYLQMNSLRAEDTAVYYCARETYYYDSSGYFDYWGQGTLVTVSS

SEQ ID NO: 1704 - protein, 123 aa, synthetic construct
EVQLVESGGGLVQPGGSLRLSCAASGFTFSSYWMSWVRQAPGKGLEWVANIKQDGSEKYYVDSVKGRFTISRDNAKNSLYLQMNSLRAEDTAVYYCARDDTIFGVVTDAFDIWGQGTMVTVSS

SEQ ID NO: 1705 - protein, 122 aa, synthetic construct
QVQLQQSGPGLVKPSQTLSLTCAISGDSVSSNSAAWNWIRQSPSRGLEWLGRTYYRSKWYNDYAVSVKSRITINPDTSKNQFSLQLNSVTPEDTAVYYCARGVGARGWFDPWGQGTLVTVSS

SEQ ID NO: 1706 - protein, 123 aa, synthetic construct
EVQLVESGGGLVKPGGSLRLSCAASGFTFSTYSMNWVRQAPGKGLEWVSSISSSSTYIYYADSVKGRFTISRDNAKNSLYLQMNSLRADDTAVYYCARDPPLSGSYAGEFDYWGQGTLVTVSS

SEQ ID NO: 1707 - protein, 123 aa, synthetic construct
QVTLRESGPALVKPTQTLTLTCTFSGFSLSTSGMCVSWIRQPPGKALEWLALIDWDDDKYYSTSLKTRLTISKDTSKNQVVLTMTNMDPVDTATYYCARRRGYSYGWGDFDYWGQGTLVTVSS

SEQ ID NO: 1708 - protein, 123 aa, synthetic construct
EVQLVESGGGLVQPGGSLRLSCAASEFIFRSYNMNWVRQAPGKGLEWVSYISISSRTIYYADSVKGRFTISRDNAKNSLFLQMNSLRDEDTAVYYCARGGLLNWNYEGWFDPWGQGTLVTVSS

SEQ ID NO: 1709 - protein, 123 aa, synthetic construct
QVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARDGGIAARPDWYFDLWGRGTLVTVSS

SEQ ID NO: 1710 - protein, 123 aa, synthetic construct
EVQLVESGGGLVQPGGSLRLSCAASGFTFSSYSMNWVRQAPGKGLEWVSYISSSSSTIYYADSVKGRFTISRDNAKNSLYLQMNSLRDEDTAVYYCARTYYYGSGSYYTLDYWGQGTLVTVSS

SEQ ID NO: 1711 - protein, 123 aa, synthetic construct
QVQLVQSGAEVKKPGASVKVSCKASGYTFTSYDINWVRQATGQGLEWMGWMNPNSGNTGYAQKFQGRVTMTRNTSISTAYMELSSLRSEDTAVYYCARGGITIFGVVTPFDYWGQGTLVTVSS

SEQ ID NO: 1712 - protein, 124 aa, synthetic construct
QVQLQESGPGLVKPSQTLSLTCTVSGGSISSGGYYWSWIRQHPGKGLEWIGYIYYSGSTYYNPSLKSRVTISVDTSKNQFSLKLSSVTAADTAVYYCARDALHYYGSGSAFDYWGQGTLVTVSS

SEQ ID NO: 1713 - protein, 124 aa, synthetic construct
EVQLVESGGGLVQPGGSLRLSCAASGFTFSSYWMSWVRQAPGKGLEWVANIKQDGSEKYYVDSVKGRFTISRDNAKNSLYLQMNSLRAEDTAVYYCAREGVLWFGEFYYYMDVWGKGTTVTVSS

SEQ ID NO: 1714 - protein, 124 aa, synthetic construct
EVQLVESGGGLVQPGGSLRLSCAASGFTFSSYSMNWVRQAPGKGLEWVSYISSSSSTIYYADSVKGRFTISRDNAKNSLYLQMNSLRDEDTAVYYCARDGDYYDSSGYYHFDYWGQGTLVTVSS

SEQ ID NO: 1715 - protein, 124 aa, synthetic construct
EVQLVESGGGLVQPGGSLRLSCAASGFTFSSYAMSWVRQAPGKGLEWVSAISGSGGSTYYADSVKGRFTISRDNSKNTLYLQMNSLRAEDTAVYYCAKDRGGENWNYGGWFDPWGQGTLVTVSS

SEQ ID NO: 1716 - protein, 124 aa, synthetic construct
QVHLVESGGGVVQPGRSLRLSCAASGFTFSSYGMHWVRQAPGKGLEWVAIIWYDGSNEYYADSVKGRFTISRDNSKNTLYLQMNTLRAEDTAVYYCAGAYYYDSSGYLNYMDVWGKGTTVTVSS

SEQ ID NO: 1717 - protein, 124 aa, synthetic construct
EVQLVESGGGLVKPGGSLRLSCAASGFTFRNAWMSWVRQAPGKGLEWVGRIKTKTDGGATQYAAPVKGRFTISRDDSKNTLYLQMNSLKTEDTAVYYCTTDHIEYSSLYYFDYWGQGTLVTVSS

SEQ ID NO: 1718 - protein, 124 aa, synthetic construct
QVQLVQSGAEVKKPGASVKVSCKASGYTFTSYGISWVRQAPGQGLEWMGWISAYNGNTNYAQKLQGRVTMTTDTSTSTAYMELRSLRSDDTAVYYCARQLAYCGGDCYLYFDYWGQGTLVTVSS

SEQ ID NO: 1719 - protein, 123 aa, synthetic construct
QVQLQQSGPGLVKPSQTLSLTCAISGDSVSSNSAAWNWIRQSPSRGLEWLGRTYYRSKWYNDYAVSVKSRITINPDTSKNQFSLQLNSVTPEDTAVYYCAREAYWNYGGFDYWGQGTLVTVSS

SEQ ID NO: 1720 - protein, 125 aa, synthetic construct
EVQLVESGGGLVKPGGSLKLSCAASGFTFSSYSMNWVRQAPGKGLEWVSSISSSSSYIYYADSVKGRFTISRDNAKNSLYLQMNSLRAEDTAVYYCARDGRITMVRGVRNWFDPWGQGTLVTVSS

SEQ ID NO: 1721 - protein, 125 aa, synthetic construct
EVQLVESGGGLVQPGGSLRLSCAASGFTFSSYSMNWVRQAPGKGLEWVSYISSSTSTIYYADSVKGRFTISRDNAKNSLYLQMNSLTDEDTAVYYCARMSSQLELHYYCYYMDVWGKGTTVTVSS

SEQ ID NO: 1722 - protein, 125 aa, synthetic construct
EVQLVESGGGLVKPGGSLRLSCAASGFTFSNAWMSWVRQAPGKGLEWVGRIKSKTDGGTTDYAAPVKGRFTISRDDSKNTLYLQMNSLKTEDTAVYYCTTDLGYSGYDWGAFDYWGQGTLVTVSS

SEQ ID NO: 1723 - protein, 124 aa, synthetic construct
QVQLQQSGPGLVKPSQTLSLTCAISGDSVSSNSAAWNWIRQSPSRGLEWLGRTYYRSKWYNDYAVSVKSRITINPDTSKNQFSLQLNSVTPEDTAVYYCARDRVNWNDVGFDYWGQGTLVTVSS

SEQ ID NO: 1724 - protein, 125 aa, synthetic construct
EVQLVESGGGLVQPGGSLRLSCAASGFTFSSYWMSWVRQAPGKGLEWVANIKQDGSEKYYVDSVKGRFTISRDNAKNSLYLQMNSLRAEDTAVYYCARTPGYSSSWYEGPYFDYWGQGTLVTVSS

SEQ ID NO: 1725 - protein, 118 aa, synthetic construct; identical to SEQ ID NO: 610

SEQ ID NO: 1726 - protein, 118 aa, synthetic construct
QLQLQESGPGLVKPSETLSLTCTVSGGSISTRSYYWGWLRQPPGKGLEWIGTFYYSGSTYYNPSLKSRVSISVDTSKNQFSLQLSSVTAADTAVYYCAREDLIGNDYWGQGTLVTVSS

SEQ ID NO: 1727 - protein, 118 aa, synthetic construct
QVQLQQWGAGLLKPSETLSLTCAVYGGSFSGHYWNWIRQPPGKGLEWIGEINHSGFTNYNPSLKSRVTISVDTPKNQFPLNLSSVTAADTAVYYCAREGLTGHVFDIWGQGTMVTVSS

SEQ ID NO: 1728 - protein, 118 aa, synthetic construct
QVQLQQWGAGLLKPSETLSLTCAVYGGFLRGYYWSWIRQPPGKGLEWIGEINHSGSTNYNPSLKSRVTISVDTAENQFSLKLNSVTAADTAVYYCAREGLTGHTFDIWGQGTMVTVSS

SEQ ID NO: 1729 - protein, 126 aa, synthetic construct
QVQLVQSGAEVKKPGASVKVSCKASGYIFSNYGICWVRQAPGQGLEWMGWINPYNVNRNYAQSLQGRVTMTTDTSTNSAYMELRSLKSDDTAVYFCARGVWGSYRSHSYYTFMDVWGKGTTVTVSS

SEQ ID NO: 1730 - protein, 126 aa, synthetic construct
EVQLVESGGGLVKPGGSLRLSCAASGFTFSSYSMNWVRQAPGKGLEWVSSISSSSSYIYYADSVKGRFTISRDNAKNSLYLQMNSLRAEDTAVYYCARDYRPYYDILTGYSHFDYWGQGTLVTVSS

SEQ ID NO: 1731 - protein, 126 aa, synthetic construct
QVQLVQSGAEVKKPGASVKVSCKASGFTFTSYYIHWVRQAPGQGLEWMGIITPSGGTTSYAQKFQGRVTMTRDTSTSTVYMELSSLRSEDTAVYYCARRVLWFGELRDYFYYMDVWGKGTTVTISS

SEQ ID NO: 1732 - protein, 126 aa, synthetic construct
QMQLQESGPGLVRPSETLSLTCTVSGGSISTRSYYWGWIRQPPGKGLEWIGSVFYSGSTYYNPSLKSRVAISVDTSKNQFSLKVNSVTAADTAVFYCVRQGYDSWTGYSFFYFDYWGQGTLVTVSS

SEQ ID NO: 1733 - protein, 119 aa, synthetic construct
QVQLQQWGAGLLKPSETLSLTCAVYGGSFSVYYWSWIRQPPGKGLEWIGEINHSGSTNYNPSLKSRVTISVDTSKNQFSLKLSSVTAADTAVYYCARGGGYSFGGFDYWGQGTLVTVSS

SEQ ID NO: 1734 - protein, 120 aa, synthetic construct
QLQLQESGPGLVKPSETLALTCTVSGGSISSIIYYWGWIRQPPGKGLEWIGNVYYSGSIYYNPSLKSRVTISVDTSKNQFSLKLSSVTAADTAVYYCARQNWGSDAFDIWGQGTMVTVSS

SEQ ID NO: 1735 - protein, 120 aa, synthetic construct
QVQLQQWGAGLLKPSETLSLTCAVYGGSFSGYYWSWIRQPPGKGLEWIGEINHSGNTNYNPSLKSRVTISVDTSKNQFSLKLSSVTAADTAVYYCARGELGIGYWYFDLWGRGTLVTVSS

SEQ ID NO: 1736 - protein, 120 aa, synthetic construct
QVQLQQWGAGLLKPSETLSLTCAVYGGSFSGYYWSWIRQPPGKGLEWIGEINHSGSTNYNPSLKSRVTISVDTSKNQFSLKLSSVTAADTAVYYCAREGGTTHEPLFDYWGQGTLVTVSS

SEQ ID NO: 1737 - protein, 132 aa, synthetic construct
QVQLVQSGAEVKKPGASMKVSCKASGYTFITYGITWVRQAPGQGLEWMGWISAYNGNANYAQKVQDRVTMTTDTSTSTAYMELRSLRSDDTAVYYCARAPGGSCGSTNCYKWNYDPYYFDYWGQGTLVTVSS

SEQ ID NO: 1738 - protein, 132 aa, synthetic construct
QVQLVQSGAEVKKPGASVKVSCKASGYTFITYGISWVRQAPGQGLEWMGWISSYNGNTNYAQKLQGRVTMTRDTSTSTAYMELRSLRSDDTAVYYCARAPGGDCSSTSCYKWNYDPYYFDYWGQGTLVTVSS

SEQ ID NO: 1739 - protein, 106 aa, synthetic construct; identical to SEQ ID NO: 786

SEQ ID NO: 1740 - protein, 110 aa, synthetic construct; identical to SEQ ID NO: 683

SEQ ID NO: 1741 - protein, 110 aa, synthetic construct; identical to SEQ ID NO: 696

SEQ ID NO: 1742 - protein, 110 aa, synthetic construct; identical to SEQ ID NO: 641

SEQ ID NO: 1743 - protein, 106 aa, synthetic construct; identical to SEQ ID NO: 1215

SEQ ID NO: 1744 - protein, 110 aa, synthetic construct; identical to SEQ ID NO: 734

SEQ ID NO: 1745 - protein, 108 aa, synthetic construct; identical to SEQ ID NO: 656

SEQ ID NO: 1746 - protein, 110 aa, synthetic construct; identical to SEQ ID NO: 772

SEQ ID NO: 1747 - protein, 115 aa, synthetic construct; identical to SEQ ID NO: 651

SEQ ID NO: 1748 - protein, 108 aa, synthetic construct; identical to SEQ ID NO: 797

SEQ ID NO: 1749 - protein, 106 aa, synthetic construct
SYELTQPPSVSVSPGQTASITCSGDKLGDKYACWYQQKPGQSPVLVIYQDSKRPSGIPERFSGSNSGNTATLTISGTQAMDEADYYCQAWDSSNVVFGGGTKLTVL

SEQ ID NO: 1750 - protein, 106 aa, synthetic construct; identical to SEQ ID NO: 786

SEQ ID NO: 1751 - protein, 106 aa, synthetic construct
SYELTQPLSVSVALGQTARITCGGNNIGSKNVHWYQQKPGQAPVLVIYRDSNRPSGIPERFSGSNSGNTATLTISRAQAGDEADYYCQVWDSSTWVFGGGTKLTVL

SEQ ID NO: 1752 - protein, 106 aa, synthetic construct; identical to SEQ ID NO: 630

SEQ ID NO: 1753 - protein, 109 aa, synthetic construct; identical to SEQ ID NO: 640

SEQ ID NO: 1754 - protein, 109 aa, synthetic construct
QAVVTQEPSLTVSPGGTVTLTCGSSTGAVTSGHYPYWFQQKPGQAPRTLIYDTSNKHSWTPARFSGSLLGGKAALTLSGAQPEDEAEYYCLLSYSGAWVFGGGTKLTVL

SEQ ID NO: 1755 - protein, 110 aa, synthetic construct; identical to SEQ ID NO: 634

SEQ ID NO: 1756 - protein, 111 aa, synthetic construct; identical to SEQ ID NO: 698

SEQ ID NO: 1757 - protein, 111 aa, synthetic construct
QSVLTQPPSVSGAPGQRVTISCTGSSSNIGAGYDVHWYQQLPGTAPKLLIYGNSNRPSGVPDRFSGSKSGTSASLAITGLQAEDEADYYCQSYDSSLSGYVFGTGTKVTVL

SEQ ID NO: 1758 - protein, 114 aa, synthetic construct
QSALTQPASVSGSPGQSITISCTGTSSDVGGYNYVSWYQQHPGKAPKLMIYDVSKRPSGVSNRFSGSKSGNTASLTISGLQAEDEADYYCCSYAGRSTLGIDWVFGGGTKLTVL

SEQ ID NO: 1759 - protein, 108 aa, synthetic construct
SYVLTQPPSVSVAPGKTARITCEGDNIGSESVHWYQQKPGQAPVLVIYFDSDRPSGIPERFSGSNSGITATLTISRVEAGDEADFYCQVWDNGSDHVVFGGGTKLTVL

SEQ ID NO: 1760 - protein, 110 aa, synthetic construct; identical to SEQ ID NO: 627

SEQ ID NO: 1761 - protein, 108 aa, synthetic construct; identical to SEQ ID NO: 661

SEQ ID NO: 1762 - protein, 106 aa, synthetic construct; identical to SEQ ID NO: 630

SEQ ID NO: 1763 - protein, 107 aa, synthetic construct; identical to SEQ ID NO: 721

SEQ ID NO: 1764 - protein, 108 aa, synthetic construct
SYELTQPPSVSVSPGQTARITCSADALSKQYAYWYQQKPGQAPVLVIYKDSERPSGIPERFSGSSSGTTVTLTISGVQAEDEADYYCQSADSSGTNWVFGGGTKLTVL

SEQ ID NO: 1765 - protein, 108 aa, synthetic construct; identical to SEQ ID NO: 661

SEQ ID NO: 1766 - protein, 110 aa, synthetic construct; identical to SEQ ID NO: 641

SEQ ID NO: 1767 - protein, 110 aa, synthetic construct
QSALTQPASVSGSPGQSITISCTGTSSDVGGYNYVSWYQQHPGKAPKLMIYEVSNRPSGVSNRFSGSKSGNTASLTISGLQAEDEADYSCSSYTISSTWVFGGGTKLTVL

SEQ ID NO: 1768 - protein, 108 aa, synthetic construct; identical to SEQ ID NO: 661

SEQ ID NO: 1769 - protein, 110 aa, synthetic construct
QSALTQPASVSGSPGQSITISCTGTSSDVGGYDYVSWYQQHPGKAPKFMISGVSNRPSGVSNRFSGSKSGNTASLTISGLQAEDEADYYCSSYTRSRTWVFGGGTKLTVL

SEQ ID NO: 1770 - protein, 115 aa, synthetic construct
QAVLTQPASLSASPGASASLTCTLRSGINVGTYRIYWYQQKPGSPPQYLLRYKSDSDKQQGSGVPSRFSGSKDASANAGILLISGLQSEDEADYYCMIWHSSASVFGGGTKLTVL

SEQ ID NO: 1771 - protein, 106 aa, synthetic construct; identical to SEQ ID NO: 673

SEQ ID NO: 1772 - protein, 106 aa, synthetic construct; identical to SEQ ID NO: 630

SEQ ID NO: 1773 - protein, 107 aa, synthetic construct
SYELTQPPSVSVSPGQTARITCSGDALPKKYAYWYQQKSGQAPVLVIYEDSKRPSGIPERFSGSSSGTMATLTISGAQVEDEADYYCYSTDSSGKGVFGGGTKLTVL

SEQ ID NO: 1774 - protein, 108 aa, synthetic construct; identical to SEQ ID NO: 661

SEQ ID NO: 1775 - protein, 108 aa, synthetic construct; identical to SEQ ID NO: 1300

SEQ ID NO: 1776 - protein, 108 aa, synthetic construct; identical to SEQ ID NO: 636

SEQ ID NO: 1777 - protein, 108 aa, synthetic construct; identical to SEQ ID NO: 661

SEQ ID NO: 1778 - protein, 108 aa, synthetic construct; identical to SEQ ID NO: 661

SEQ ID NO: 1779 - protein, 110 aa, synthetic construct
QSALTQPASVSGSPGQSITISCTGTNNDVGYYNYVSWYQQHPDKAPKLMIYDVIKRPSGVSDRFSGSKSGNTASLTISGLQAEDEADYYCCSYAGSSTWVFGGGTKLSVL

SEQ ID NO: 1780 - protein, 110 aa, synthetic construct
QSALTQPPSASGSPGQSVTISCTGTSSDVGGYNYVSWYQQHPGKAPKLMIYEVSKRPSGVPDRFSGSKSGNTASLTVSGLQAEDEADYYCSSYSGSNNYVFGTGTKVTVL

SEQ ID NO: 1781 - protein, 110 aa, synthetic construct
QSALTQPASVSGSPGQSITISCTGTSSDVGNYNYVSWYQQHPGKVPKLMIYEVIYRPSGVSNRFSGSKSGNTASLTISGLQAEDEADYYCTSYTRNNTYVFGSGTKVTVL

SEQ ID NO: 1782 - protein, 111 aa, synthetic construct; identical to SEQ ID NO: 783

SEQ ID NO: 1783 - protein, 111 aa, synthetic construct; identical to SEQ ID NO: 635

SEQ ID NO: 1784 - protein, 114 aa, synthetic construct
QSALTQPASVSGSPGQSITISCTGTSSDVGGYNYVSWYQQHPGKAPKLMIYDVSKRPSGVSNRFSGSKSGNTASLTISGLQAEDEADYYCCSYAGRSTLGIDWVFGGGTKLTVR

SEQ ID NO: 1785 - protein, 108 aa, synthetic construct; identical to SEQ ID NO: 678

SEQ ID NO: 1786 - protein, 108 aa, synthetic construct
SYELTQPPSVSVSLGQMARITCSGEALPKKYAYWYQQKPGQFPVLVIYKDSERPSGIPERFSGSSSGTIVTLTISGVQAEDEADYYCLSADSSGTYRVFGGGTKLTVL

SEQ ID NO: 1787 - protein, 110 aa, synthetic construct
QSALTQPASVSGSPGQSITISCTGTSSDVGGYNYVSWYQQHPGKAPKLMIYEVSHRPSGVSNRFSGSKSGNTASLTISGLQAEDESDYYCSSYTSSSSLVFGGGTKLTVL

SEQ ID NO: 1788 - protein, 110 aa, synthetic construct; identical to SEQ ID NO: 627

SEQ ID NO: 1789 - protein, 110 aa, synthetic construct
QSALTQPRSVSGSPGQSVTISCTGTSSDVGGYNYVSWYQQHPGKAPKLMIYDVTTRPSGVPDRFSGSKSGNTASLTISGLQAEDEADYYCCSYSGSYTYVFGTGTKVTVL

SEQ ID NO: 1790 - protein, 110 aa, synthetic construct
QSALTQPASVSGSPGQSITISCTGTSSDVGGYNYVSWYQQHPGKVPKLMIYEVSNRPSGVSNRFSGSKSGNTASLTISGLQAEDEADYYCISYTNTNTRVFGGGTKLTVL

SEQ ID NO: 1791 - protein, 110 aa, synthetic construct; identical to SEQ ID NO: 627

SEQ ID NO: 1792 - protein, 110 aa, synthetic construct; identical to SEQ ID NO: 695

SEQ ID NO: 1793 - protein, 111 aa, synthetic construct
QSALTQPPSASGSPGQSVTISCTGTSSDVGGYNYVSWYQQHPGKAPKLMIYEVSKRPSGVPDRFSGSKSGNTASLTVSGLQAEDEADYYCSSYAGSNNFWVFGGGTKLTVL

SEQ ID NO: 1794 - protein, 111 aa, synthetic construct
QSALTQPASVSGSPGQSITISCTGTSSDVGGYNYVSWYQQHPGKAPKLMIYEVSNRPSGVSNRFSGSKSGNTASLTISGLQAEDEADYYCSSYTSSSTYWVFGGGTKLTVL

SEQ ID NO: 1795 - protein, 106 aa, synthetic construct; identical to SEQ ID NO: 663

SEQ ID NO: 1796 - protein, 106 aa, synthetic construct; identical to SEQ ID NO: 673

SEQ ID NO: 1797 - protein, 108 aa, synthetic construct; identical to SEQ ID NO: 661

SEQ ID NO: 1798 - protein, 108 aa, synthetic construct; identical to SEQ ID NO: 636

SEQ ID NO: 1799 - protein, 110 aa, synthetic construct; identical to SEQ ID NO: 641

SEQ ID NO: 1800 - protein, 111 aa, synthetic construct; identical to SEQ ID NO: 1207

SEQ ID NO: 1801 - protein, 106 aa, synthetic construct
SYELTQPPSVSVSPGQTASITCSRDKLGDKYACWYQQKPGQSPVLVIYQDSKRPSGIPERFSGSNSGNTATLTISGTQAMDEADYYCQAWDSSTVVFGGGTKLTVL

SEQ ID NO: 1802 - protein, 106 aa, synthetic construct
SYELTQPPSVSVSPGQTASITCSGDKLGDRYACWYQQKPGQSPVLVIYQGSKRPSGIPERFSGSNSGNTATLTISGTQAMDEADYYCQAWDSSTVVFGGGTKLTVL

SEQ ID NO: 1803 - protein, 106 aa, synthetic construct
SSELTQDPAVSVALGQTVRITCQGDSLRSYYASWYQQKPGQAPVLVIYGKNNRPSGILDRFSGSSSGNTASLTITGAQAEDEGDYYCNSRDSSGWVFGGGTKLTVL

SEQ ID NO: 1804 - protein, 107 aa, synthetic construct
SYELTQPPSVSVSPGQTANITCSGDKLENKYTCWYQQKPGQSPLVVIYQDNKRPSGIPERFSGSNSGNTATLTISGTQAMDEADYYCQAWDSTTAWVFGGGTKLTVL

SEQ ID NO: 1805 - protein, 108 aa, synthetic construct
SSELTQDPAVSVALGQTVRITCQGDNIRNYYASWYQQKPGQAPLLVISGKNNRPSGIPDRFSGSSSGNTASLTITGAQAEDEAYYYCYSRDSSGSLWIFGGGTKLTVL

SEQ ID NO: 1806 - protein, 108 aa, synthetic construct
SSELTQDPAVSVALGQTVRITCQGDSLRRYYASWYQQKPGQAPVLVIYGKDNRPSGIPDRFSGSSSGNTASLTITGTQAEDEADYYCNSRDSSGNHLVFGGGTKLTVL

SEQ ID NO: 1807 - protein, 108 aa, synthetic construct; identical to SEQ ID NO: 1300

SEQ ID NO: 1808 - protein, 108 aa, synthetic construct; identical to SEQ ID NO: 661

SEQ ID NO: 1809 - protein, 108 aa, synthetic construct; identical to SEQ ID NO: 661

SEQ ID NO: 1810 - protein, 108 aa, synthetic construct; identical to SEQ ID NO: 661

SEQ ID NO: 1811 - protein, 108 aa, synthetic construct
SYELTQPPSVSVSPGQTARITCSGDALPKKYAYWYQQKSGQAPVLVIYEDIKRPSGIPERFSGSSSGTMATLTISGAQVEDEADYYCYSTDSSGNHRVFGGGTKLTVL

SEQ ID NO: 1812 - protein, 110 aa, synthetic construct; identical to SEQ ID NO: 632

SEQ ID NO: 1813 - protein, 110 aa, synthetic construct
QSALTQPASVSGSPGQSITISCTGTSSDVGGYNYVSWYQQHPGKAPKLMIYDVSKRPSGVSNRFSGSKSGNTASLTISGLQAEDEADYYCCSYAGSSTVVFGGGTKLTVL

SEQ ID NO: 1814 - protein, 110 aa, synthetic construct; identical to SEQ ID NO: 695

SEQ ID NO: 1815 - protein, 110 aa, synthetic construct
QSALTQPASVSGSPGQSITISCTGTSSDVGGYNYVSWYQQHPGKAPKLMIYEVSNRPSGVSNRFSGSKSGNTASLTISGLQAEDEADYYCSSYTSSSHVVFGGGTKLTVL

SEQ ID NO: 1816 - protein, 106 aa, synthetic construct; identical to SEQ ID NO: 663

SEQ ID NO: 1817 - protein, 106 aa, synthetic construct; identical to SEQ ID NO: 663

SEQ ID NO: 1818 - protein, 106 aa, synthetic construct; identical to SEQ ID NO: 630

SEQ ID NO: 1819 - protein, 107 aa, synthetic construct
SYELTQPPSVSVSPGQTARITCSGDALPQKYAFWYQQKSGQAPVLVIYEDSERPSGIPERFSGSTSGTMATLTISGAQVEDEADYYCFSTDSSGNKVFGGGTKLTVL

SEQ ID NO: 1820 - protein, 107 aa, synthetic construct; identical to SEQ ID NO: 742

SEQ ID NO: 1821 - protein, 107 aa, synthetic construct; identical to SEQ ID NO: 742

SEQ ID NO: 1822 - protein, 108 aa, synthetic construct; identical to SEQ ID NO: 1300

SEQ ID NO: 1823 - protein, 108 aa, synthetic construct
SSELTQDPAVSVALGQTVRITCQGDSLRNYYASWYQQKPGQAPILVIYGKNNRPSGIPDRFSGSSSGNTASLTITGAQAEDEADYYCNSRDSSYNHWVFGGGTKLTVL

SEQ ID NO: 1824 - protein, 108 aa, synthetic construct; identical to SEQ ID NO: 678

SEQ ID NO: 1825 - protein, 108 aa, synthetic construct; identical to SEQ ID NO: 661

SEQ ID NO: 1826 - protein, 108 aa, synthetic construct; identical to SEQ ID NO: 678

SEQ ID NO: 1827 - protein, 108 aa, synthetic construct; identical to SEQ ID NO: 666

SEQ ID NO: 1828 - protein, 108 aa, synthetic construct
SSELTQDPAVSVALGQTVRITCQGDSLRSYYASWYQQKPGQAPVLVIYGKNNRPSGIPDRFSGSSSGNTASLTITGAQAEDEADYYCNSRDSSDNHRVFGGGTKLTVL

SEQ ID NO: 1829 - protein, 108 aa, synthetic construct
SSELTQDPAVSVALGQTVRITCQGDSLRSYYASWYQQKPGQAPVLVIYGQNNRPSGIPDRFSGSSSGNTASLTITGAQAEDEADYYCNSRDSSGNHWVFGGGTKLTVL

SEQ ID NO: 1830 - protein, 108 aa, synthetic construct; identical to SEQ ID NO: 678

SEQ ID NO: 1831 - protein, 110 aa, synthetic construct
QSVLSQPPSVSEAPRQRVTISCSGSSSNIGYNAVNWYQQLPGKAPKLLISHDDLLPSGVSDRFSGSKSGTSASLAISGLQSDDEADYYCAAWDARLNGWVFGGGTKLTVL

SEQ ID NO: 1832 - protein, 110 aa, synthetic construct; identical to SEQ ID NO: 632

SEQ ID NO: 1833 - protein, 111 aa, synthetic construct
QSVLTQPPSVSGAPGQRVTISCTGSSSNIGARYDVHWYQLLPGSAPKLLIYDNSDRPSGVPDRFSGSRSGTSASLAITGLQAEDEADYFCQSYDSSLSGSVFGGGTKLTVL

SEQ ID NO: 1834 - protein, 111 aa, synthetic construct; identical to SEQ ID NO: 783

SEQ ID NO: 1835 - protein, 111 aa, synthetic construct
QSVLTQPPSVSGAPGQRVTISCTGSSSNIGAGYDVHWYQQLPGTAPKLLIHGNSNRPSGVPDRFSGSKSGTSASLAITGLQAEDETDYYCQSYDSSLSGWVFGGGTKLTVL

SEQ ID NO: 1836 - protein, 115 aa, synthetic construct
QAVLTQPASLSASPGASASLTCTLRSGINVGTSRIYWYQQKPGSPPQYLLRYKSDSDKHQDSGVPSRFSGSKDASANAGILLISGLQSEDEADYYCMIWHSSAVVFGGGTKLTVL

SEQ ID NO: 1837 - protein, 116 aa, synthetic construct
QAVLTQPASLSASPGASASLTCTLRSGINVGTYRIYWYQQKPGSPPQYLLRYKSDSDKQQGSGVPSRFSGSKDASANAGILLISGLQSEDEADYYCMIWHSSASVVFGGGTKLTVL

SEQ ID NO: 1838 - protein, 106 aa, synthetic construct
SYELTQPPSVSVSPGQTAIITCSGAKLGDKYACWYQKKPGQSPVMVIYQDRKRPSGIPERFSGSNSGNTATLTISGTQAMDEADYYCQAWDSSTAVFGGGTKLTVL

SEQ ID NO: 1839 - protein, 108 aa, synthetic construct; identical to SEQ ID NO: 661

SEQ ID NO: 1840 - protein, 106 aa, synthetic construct
SSELTQDPAVSVALGQTVRITCQGDSLRSYYASWYQQKPGQAPVLVIYGKNNRPSGIPDRFSGSSSGNTASLTITGAQAEDEADYYCNSRDSSGNLFGGGTKLTVL

SEQ ID NO: 1841 - protein, 106 aa, synthetic construct
SYELTQPPSVSVSPGQTASITCSGDKLGDKYACWYQQKPGQSPVLVIYQDSKRPSGIPERISGSNSGNTATLTISGTQAMDEADYYCQAWDSSTAVFGGGTKLTVL

SEQ ID NO: 1842 - protein, 108 aa, synthetic construct; identical to SEQ ID NO: 666

SEQ ID NO: 1843 - protein, 108 aa, synthetic construct; identical to SEQ ID NO: 661

SEQ ID NO: 1844 - protein, 108 aa, synthetic construct; identical to SEQ ID NO: 661

SEQ ID NO: 1845 - protein, 108 aa, synthetic construct; identical to SEQ ID NO: 661

SEQ ID NO: 1846 - protein, 111 aa, synthetic construct
QSVLTQPPSVSGAPGQRVTISCTGSSSNIGAGYDVHWYQQLPGTAPKLLIYGNSNRPSGVPDRFSGSKSGTSASLAITGLQAEDEADYYCQSYDSSLSGVVFGGGTKLTVL

SEQ ID NO: 1847 - protein, 115 aa, synthetic construct; identical to SEQ ID NO: 701

SEQ ID NO: 1848 - protein, 106 aa, synthetic construct; identical to SEQ ID NO: 663

SEQ ID NO: 1849 - protein, 108 aa, synthetic construct
SSELTQDPAVSVALGQTVRITCQGDSLRRYYASWYQQKPGQAPVLVIYGKNNRPSGIPDRFSGSSSGNTASLTITGAQAEDEADYYCNSRDSSGNHLVFGGGTKLTVL

SEQ ID NO: 1850 - protein, 108 aa, synthetic construct; identical to SEQ ID NO: 661

SEQ ID NO: 1851 - protein, 108 aa, synthetic construct; identical to SEQ ID NO: 661

SEQ ID NO: 1852 - protein, 108 aa, synthetic construct
SYVLIQPPSVSVAPGKTARITCGGNNIGGKSVHWYQLKPGQAPVLVICYNRDRPSGIPERFSGSNSGNTATLTISRVEAGDEADYYCQVWDSSSDHPVFGGGTKLTVL

SEQ ID NO: 1853 - protein, 109 aa, synthetic construct
QSVLTQSPSASGTPGQRVTISCSGSNSNIGFNTVNWYQQLPGTAPKLLIDSNNQRPSGVPDRFSGSTSGTSASLAISGLQSEDEADYYCSSYAGSNNFVFGTGTKVTVL

SEQ ID NO: 1854 - protein, 110 aa, synthetic construct; identical to SEQ ID NO: 633

SEQ ID NO: 1855 - protein, 111 aa, synthetic construct
QSALTQPPSASGSPGQSVTISCTGTSSDVGGYNYVSWYQQHPGKAPKLMIYEVSKRPSGVPDRFSGSKSGNTASLTVSGLQAEDEADYYCSSYAGSNNFGVFGGGTKLTVL

SEQ ID NO: 1856 - protein, 106 aa, synthetic construct
SYELTQPPSVSVSPGQTANITCSGDKLGNKYACWYQQKPGQSPVLVIFQDNKRPSGIPERFSGSNSGNTATLTIGGTQAMDEADYYCQAWDSSTVVFGGGTKVTVL

SEQ ID NO: 1857 - protein, 106 aa, synthetic construct
SYDLTQPPSVSVSPGQTASITCSGDKLGDKYACWYQQKPGQSPVLVIYQDIKRPSGIPERFSGSNSGNTATLTISGTQAMDEADYYCQAWDSSTVVFGGGTKLTVL

SEQ ID NO: 1858 - protein, 106 aa, synthetic construct
SYELTQPPSVSVSPGQTASITCSGDKLGDKYACWYQQKPGQSPVLVIYQDSMRPSGIPERFSGSNSGNTATLTISGTQAMDEADYYCQAWDSSTVVFGGGTKLTVL

SEQ ID NO: 1859 - protein, 106 aa, synthetic construct; identical to SEQ ID NO: 663

SEQ ID NO: 1860 - protein, 108 aa, synthetic construct; identical to SEQ ID NO: 707

SEQ ID NO: 1861 - protein, 108 aa, synthetic construct; identical to SEQ ID NO: 661

SEQ ID NO: 1862 - protein, 108 aa, synthetic construct
QSVLTQPPSASGTPGQRVTISCSGSSSNIGINTVNWYQQVPGTAPKLLIYFNNQRPSGVPDRFSGSKSGTSASLAISGLQSEDEADYYCAAWDDSLKVFGGGTKLTVL

SEQ ID NO: 1863 - protein, 109 aa, synthetic construct; identical to SEQ ID NO: 1289

SEQ ID NO: 1864 - protein, 110 aa, synthetic construct; identical to SEQ ID NO: 1813

SEQ ID NO: 1865 - protein, 106 aa, synthetic construct
SYELTQPSSVSVSPGQAARITCSGNLLAKKYPRWFLQKPGQAPIMLTHTDCERPSGIPERFSGSSSGTTVTLTISGAQVEDEADYYCFSAADNTSVFDGGTNLTVL

SEQ ID NO: 1866 - protein, 108 aa, synthetic construct; identical to SEQ ID NO: 636

SEQ ID NO: 1867 - protein, 108 aa, synthetic construct
SYELTQPPSVSVSPGQTARITCSGDALPKKYAYWFQQKSGQAPVLVIYEDSKRPSGIPERFSGSSSGTMATLIISGAQVEDEADYYCYSTDSSGNHVVFGGGTKLTVL

SEQ ID NO: 1868 - protein, 110 aa, synthetic construct; identical to SEQ ID NO: 633

SEQ ID NO: 1869 - protein, 110 aa, synthetic construct
QSVLNQPPSASGTPGQRVTISCSGSSSNIGSKTVNWYQQVPGTAPKLLIYSSNQRPSGVPDRFSGSKSGTSASLAISELQSEDEADYYCTSWDDSLNTWVFGGGTKLTVL

SEQ ID NO: 1870 - protein, 106 aa, synthetic construct
SYELTQPLSLSVALGQTARITCGENNIGSRNVHWYQQKPGQAPVLVIYRDSDRPSGIPERFSGSNSGNTATLTISRAQAGDEADYFCQVWDSSTAVFGGGTKLTVL

SEQ ID NO: 1871 - protein, 108 aa, synthetic construct; identical to SEQ ID NO: 636

SEQ ID NO: 1872 - protein, 108 aa, synthetic construct; identical to SEQ ID NO: 661

SEQ ID NO: 1873 - protein, 110 aa, synthetic construct
RSALTQPASVSGSPGQSITISCTGTSSDVGGYNYVSWYHQHPGKAPKLMIYDVSKRPSGVSNRFSGFKSGNTASLTISGLQAEDEADYFCCSYAGSSTLVFGGGTKLTVL

SEQ ID NO: 1874 - protein, 110 aa, synthetic construct
QSALTQPASVSGSPGQSITISCTGTSSDVGGYNHVSWYQQNPGKAPKLMIYDVSKRPSGVSNRFSGSKSGNTASLTISGLQAEDEADYYCCSYAGSSTLVFGGGTKLTVL

SEQ ID NO: 1875 - protein, 123 aa, synthetic construct
QVQLQESGPGLVKPSQTLSLTCTVSGGSISSGGYYWSWIRQHPGKGLEWIGNIYYSGNPYYNPSLKSRLIISVDTSKNQFSLRLNSVTAADTAVYYCATFYYGSGSYYNEDYWGQGTLVTVSS

SEQ ID NO: 1876 - protein, 117 aa, synthetic construct
QVQLVESGGGLVKPGGSLRLSCAASGFTFSDSYMSWIRQAPGKGLEWVSYISNSGSYMYYADSVKGRFTISRDNAKNSLYLQMNNLRAEDTAVYYCARDKLGIGDYWGQGTLVTVSS

SEQ ID NO: 1877 - protein, 117 aa, synthetic construct
QVQLQESGPGLVKPSETLSLTCTVSGGSISSYDWSWIRQPPGKGLEWIGYIYYSGSTNYNPSLKSRVTISVDTSKNQFSLKLRSVTAADTAVYYCARKYSYGPFDNWGQGTLVTVSS

SEQ ID NO: 1878 - protein, 128 aa, synthetic construct
QVQLQESGPGLVKPSQTLSLTCDISGDSVSSNSAAWNWIRQSPSRGLEWLGRTYYRSKWYNDYAVAVKSRITINPDTSKNQFSLQLNSVTPEDTAVYYCARESSGWYEDYYYYYMDVWGKGTTVTVSS

SEQ ID NO: 1879 - protein, 119 aa, synthetic construct
QLQLQESGPGLVKPSETLSLTCTVSGGSISSSNHYWGWIRQPPGKGLEWIGTLYYSGSTYYEPSLKSRVTISVDTSMNQFSLNLSSVTATDTAVYNCARGDRYGPFDYWGQGTLVTVSS

SEQ ID NO: 1880 - protein, 127 aa, synthetic construct
EVQLVESGGGLVKPGGSLRLSCAASGFTFTNAWMNWVRQAPGKGLEWIGRIKSKTAGETTDYAAPVKGRFTISRDDSKNTLYLQMNSLKTEDTAVYYCTTDPDYGDPYYYYYFMDVWGKGTTVTVSS

SEQ ID NO: 1881 - protein, 118 aa, synthetic construct
QVQLVQSGVEVKKPGASVKVSCKASGYAFSNNDISWVRQAPGQGLEWMAWITTSNGNTNYAPKLQGRVTMTTDTSTSTAYMELRSLKSDDTAVYYCARGGRTGYFDYWGQGTLVTVSS

SEQ ID NO: 1882 - protein, 120 aa, synthetic construct
QVQLQESGPGLVKPSGTLSLTCAVSGGSITTNNWWSWVRQSPGKGLEWIGEIYHSGNTNYNPSLKSRVTMSVDKSKNQFSLNLNSVIVADTAVYYCASALGTYYGAFDTWGQGTMVTVSA

SEQ ID NO: 1883 - protein, 118 aa, synthetic construct
QVQLVESGGGVVQPGRSLRLSCAASGFTFSSYGMHWVRQAPGKGLEWVAFIWYDGRNKNYVDSVKGRFTISRDNSKNTLYLQMNSLRAEDTAVYYCARDRGDYVFDYWGQGTLVTVSS

SEQ ID NO: 1884 - protein, 121 aa, synthetic construct
QVQLVESGGGLVQPGRSLRLSCAASGFTFDDYAIHWVRQAPGKGLEWVSGISYNSENIGYADSVKGRFTISRDNAKNSLYLQMNSLRSEDTALYYCAKDMFLTWFSSFDYWGQGTLVTVSS

SEQ ID NO: 1885 - protein, 120 aa, synthetic construct
QVQLQESGPGLVKPSGTLSLTCAVSGGSISSSNWWSWVRQPPGKGLEWIGEIYHSGSINYNPSLKSRVTISVDKSKNQFSLKLTSVTAADTAVYYCASALGNYYGAFDLWGQGTMVTVSS

SEQ ID NO: 1886 - protein, 119 aa, synthetic construct
QLQLQESGPGLAKPSETLSLTCTVSGVSISSNSYYWGWIRQPPGKGLEWIGNIYHSGRTYYNPSLRSRVTISVDTSKNQFSLKLNSVTAADTAVYYCARGYSYGAFDYWGQGTLVTVSS

SEQ ID NO: 1887 - protein, 119 aa, synthetic construct
QLQLQESGPGLVKPSETLSLTCSVSGGSISSSGYYWGWIRQPPGKGLDWIGTIYYSGNTNYNPSLNSRVTISVDTSRNQFSLKLRSVTAADTAVYYCARGYSYGPFDYWGQGTLVTVSS

SEQ ID NO: 1888 - protein, 121 aa, synthetic construct
QVQLVESGAEVKKPRASVKVSCKTSGYTFTRHYMHWVRQAPGQGLEWMGIINPNNNSTSYAQKFQGRITMTRDTSTSTVYMELSSLRSEDTAVYYCARFRIVGTTLYFDYWGQGTLVTVSS

SEQ ID NO: 1889 - protein, 117 aa, synthetic construct; identical to SEQ ID NO: 1876

SEQ ID NO: 1890 - protein, 125 aa, synthetic construct
QVQLVQSGAEVKKPGASVKVSCKASGYTFSSFGITWIRQAPGQGLEWMGWISGYTGNTNYAQNLQGRVTITTDTSTNTAYMELRSLKSDDTAVYYCAREPVLNPNYYYFYYMDVWGQGTTVTVSS

SEQ ID NO: 1891 - protein, 119 aa, synthetic construct
QVQLVQSGAEVKKPGASMKVSCKASGYTFTQNHISWVRQAPGQGLEWMGWISAYSGNTNYAWKFQGRVTMTTDTSTNTAYMELRSLRSDDTAVYYCARDRGNWNDFAYWGRGTLVTVSS

SEQ ID NO: 1892-1955 - skipped (64 entries)

SEQ ID NO: 1956 - protein, 107 aa, synthetic construct
DIQMTQSPSSLSASVGDRVTITCRASQGIRIDLGWYQQKPGKAPKRLIYAASSLKSGVPSRFSGSGSGTEFTLTISSLQPEDFTTYFCLQHNSYPYTFGQGTKLEIK

SEQ ID NO: 1957 - protein, 107 aa, synthetic construct
DIQMTQSPSSLSASVGDRVTITCRASQGIRNDLGWFQQKPGKAPKRLIYAASRLQSGVPSRFSGSGSGTEFTLTISSLQPEDFATYCCLQHHTYPPTFGQGTKVEIK

SEQ ID NO: 1958 - protein, 107 aa, synthetic construct
DIVMTQSPSSLSPSVGDRVTITCRASQGINNYLAWYQQKPGKVPQLLIYAASTLQSGVPSRFSGSGSGTDFTLTISSLQPEDVATYYCQKYNSXPFTFGPGTKVDIK

SEQ ID NO: 1959 - protein, 107 aa, synthetic construct
DIQMTQSPSSLSASVGDRVTITCRASQSISSYLNWYQQKPGKAPKLLIYAASSLQSGVPSRFSGSGSGTDFTLTISSLQPEDFATYYCQQSYSTPFTFGPGTKVDIK

SEQ ID NO: 1960 - protein, 107 aa, synthetic construct
DIVMTQSPSSLSASVGDRVTITCRASQGIRDDLGWYQQKPEKAPKRLICAASSLQSGVPSRFSGSGSGTEFTLTISSLQPEDFATYYCLQYNRYPWTFGQGTKVEIK

SEQ ID NO: 1961 - protein, 107 aa, synthetic construct
DIQMTQSPSSLSASIGDRVTISCRASQSISSYLNWYQQKPGKAPKLLIYGASSLQSGVPSRFSGSGSGTDFTLTISSLQPEDFATYYCQQSYSLPLTFGGGTKVEIK

SEQ ID NO: 1962 - protein, 112 aa, synthetic construct
DIVMTQSPLSLPVTPGEPASISCRSSQSLLHSNGYNYLDWYLQKPGQSPQLLIYLGSNRASGVPDRFSGSGSGTDSTLKISRVEAEDVGVYYCMQVLQIPLTFGGGTKVEIR

SEQ ID NO: 1963 - protein, 107 aa, synthetic construct
DIQMTQSPSSLSASVGDRVTITCRASQSISNYLNWYQQKPGKAPKLLIYAASSLQSGVPSRFSGSGSGTDFTLTISSLQPEDFTTYYCQQSYGTPYTFGQGAKLQIK

SEQ ID NO: 1964 - protein, 107 aa, synthetic construct
DIQMTQSPSSLSASVGDRVTITCQASQDIRNYLNWYQQKPGKAPKLLIYDASNLETGVPSRFSGSGSGTDFTFTISSLKPEDIATYYCQQYDNLLFTFGPGTKVDIK

SEQ ID NO: 1965 - protein, 108 aa, synthetic construct
ETKLTQSPGTLSLSPGERTTLSCRASQSISNNYLAWYQQKPGQAPRLLIYRASTRATGIPDRFSGSGSGTDFTLTIRRLEPEDFAVYYCQRYGRSPLTFGGGTKVEIK

SEQ ID NO: 1966 - protein, 107 aa, synthetic construct
DIVMTQSPSSLSASVGDRVTITCRASQTISSYLNWYQQKPGKAPKLLICAASSLQGGVPSRFSGSGSGTDFTLTISSLQPEDFAPYYCQQSYSTPYTFGQGTKLEIK

SEQ ID NO: 1967 - protein, 107 aa, synthetic construct
DIQMTQSPSSLSASVGDRVTITCRASQGIRNDLGWYQQKPGKAPKRLIYAASSLQSGIPSRFSGSGSGTEFTLTISSLQPEDFATYYCLQHNNYPWTFGQGTKVEIK

SEQ ID NO: 1968 - protein, 107 aa, synthetic construct
EIVMTQSPATLSVSPGERATLSCRASQSVSSNLAWYQLKPGQAPRLLIYGASTRATGIPARFSGSGSGTEFTLTISSLQSEDFAVYYCHPYNNWPLTFGGGTKVEIK

SEQ ID NO: 1969 - protein, 107 aa, synthetic construct; identical to SEQ ID NO: 1968

SEQ ID NO: 1970 - protein, 112 aa, synthetic construct; identical to SEQ ID NO: 1962

SEQ ID NO: 1971 - protein, 107 aa, synthetic construct
EIQLTQSPGTLSLSPGERATLSCRASQSVRNSYLAWYQQKPGQAPRLLTYGASSRATGIPDRFSGSGSGTDFTLTISRLEPEDCAVYFCQQYGSSPTFGGGTKVDIK

SEQ ID NO: 1972 - protein, 113 aa, synthetic construct
DIVMTQSPDSLAVSLGERATINCKSSQSVLYSSNNKNYLAWYQQKPGQPPKLLIYWASTRESGVPDRFSGSGSGTDFTLTISSLQAEDVAVYYCQQYYSTPYTFGQGTKLEIK

SEQ ID NO: 1973-2067 - skipped (95 entries)

SEQ ID NO: 2068 - protein, 9 aa, synthetic construct
GDSVSSNSA

SEQ ID NO: 2069 - protein, 9 aa, synthetic construct
GDSVSSNSA

SEQ ID NO: 2070 - protein, 7 aa, synthetic construct
GFTFDDY

SEQ ID NO: 2071 - protein, 9 aa, synthetic construct
GGSISSSSY

SEQ ID NO: 2072 - protein, 7 aa, synthetic construct
GFTFSSY

SEQ ID NO: 2073 - protein, 7 aa, synthetic construct
GFTFNNY

SEQ ID NO: 2074 - protein, 7 aa, synthetic construct
GFTFSSY

SEQ ID NO: 2075 - protein, 7 aa, synthetic construct
GFTFSSY

SEQ ID NO: 2076 - protein, 7 aa, synthetic construct
GYTFTSY

SEQ ID NO: 2077 - protein, 7 aa, synthetic construct
GGSFSGY

SEQ ID NO: 2078 - protein, 7 aa, synthetic construct
GFTFSSY

SEQ ID NO: 2079 - protein, 7 aa, synthetic construct
GFSFSGS

SEQ ID NO: 2080 - protein, 7 aa, synthetic construct
GYTFTGY

SEQ ID NO: 2081 - protein, 7 aa, synthetic construct
GYTFINY

SEQ ID NO: 2082 - protein, 7 aa, synthetic construct
GFTFSSY

SEQ ID NO: 2083 - protein, 8 aa, synthetic construct
GGSISSSN

SEQ ID NO: 2084 - protein, 9 aa, synthetic construct
GFSLSTSGV

SEQ ID NO: 2085 - protein, 7 aa, synthetic construct
GFTFSSY

SEQ ID NO: 2086 - protein, 7 aa, synthetic construct
GFTFSNA

SEQ ID NO: 2087 - protein, 7 aa, synthetic construct
GFTFSSY

SEQ ID NO: 2088 - protein, 7 aa, synthetic construct
GFTFDDY

SEQ ID NO: 2089 - protein, 7 aa, synthetic construct
GYSFTSY

SEQ ID NO: 2090 - protein, 7 aa, synthetic construct
GYTFTSY

SEQ ID NO: 2091 - protein, 9 aa, synthetic construct
GDSVSSNSA

SEQ ID NO: 2092 - protein, 7 aa, synthetic construct
GGSFSGY

SEQ ID NO: 2093 - protein, 7 aa, synthetic construct
GFTFSSY

SEQ ID NO: 2094 - protein, 7 aa, synthetic construct
GFTFSNA

SEQ ID NO: 2095 - protein, 9 aa, synthetic construct
GGSISSGGY

SEQ ID NO: 2096 - protein, 9 aa, synthetic construct
GGSISSGGY

SEQ ID NO: 2097 - protein, 7 aa, synthetic construct
GFTFSNA

SEQ ID NO: 2098 - protein, 7 aa, synthetic construct
GYTFTSY

SEQ ID NO: 2099 - protein, 7 aa, synthetic construct
GYTFTTY

SEQ ID NO: 2100 - protein, 7 aa, synthetic construct
GFTFSSY

SEQ ID NO: 2101 - protein, 7 aa, synthetic construct
GFTFSNA

SEQ ID NO: 2102 - protein, 7 aa, synthetic construct
GYTFTSY

SEQ ID NO: 2103 - protein, 7 aa, synthetic construct
GFTFSNA

SEQ ID NO: 2104 - protein, 7 aa, synthetic construct
GFTFSSY

SEQ ID NO: 2105 - protein, 7 aa, synthetic construct
GYTFTSY

SEQ ID NO: 2106 - protein, 7 aa, synthetic construct
GFTFSNA

SEQ ID NO: 2107 - protein, 7 aa, synthetic construct
GFTFSSY

SEQ ID NO: 2108 - protein, 7 aa, synthetic construct
GFTFSSY

SEQ ID NO: 2109 - protein, 7 aa, synthetic construct
EFTFRNA

SEQ ID NO: 2110 - protein, 7 aa, synthetic construct
GFTFSNA

SEQ ID NO: 2111 - protein, 7 aa, synthetic construct
GFTFSNY

SEQ ID NO: 2112 - protein, 7 aa, synthetic construct
GFTFSDY

SEQ ID NO: 2113 - protein, 7 aa, synthetic construct
GYTFTNY

SEQ ID NO: 2114 - protein, 7 aa, synthetic construct
GYTFTSY

SEQ ID NO: 2115 - protein, 7 aa, synthetic construct
GFTFSSY

SEQ ID NO: 2116 - protein, 7 aa, synthetic construct
GFTFSNA

SEQ ID NO: 2117 - protein, 7 aa, synthetic construct
GFTFSNA

SEQ ID NO: 2118 - protein, 7 aa, synthetic construct
GFTFSSY

SEQ ID NO: 2119 - protein, 7 aa, synthetic construct
GFTFSSY

SEQ ID NO: 2120 - protein, 7 aa, synthetic construct
RYTFTSY

SEQ ID NO: 2121 - protein, 7 aa, synthetic construct
GFTFSSY

SEQ ID NO: 2122 - protein, 7 aa, synthetic construct
GLTVSTN

SEQ ID NO: 2123 - protein, 7 aa, synthetic construct
GFTFDDY

SEQ ID NO: 2124 - protein, 7 aa, synthetic construct
GFTVSSN

SEQ ID NO: 2125 - protein, 7 aa, synthetic construct
GFTFSSY

SEQ ID NO: 2126 - protein, 7 aa, synthetic construct
GFTFSSY

SEQ ID NO: 2127 - protein, 8 aa, synthetic construct
GGSISSNN

SEQ ID NO: 2128 - protein, 7 aa, synthetic construct
GYTFTRN

SEQ ID NO: 2129 - protein, 7 aa, synthetic construct
GFTFSSY

SEQ ID NO: 2130 - protein, 7 aa, synthetic construct
GYTFTSY

SEQ ID NO: 2131 - protein, 7 aa, synthetic construct
GFTFSSY

SEQ ID NO: 2132 - protein, 7 aa, synthetic construct
GFTFSSY

SEQ ID NO: 2133 - protein, 7 aa, synthetic construct
GYSFTSY

SEQ ID NO: 2134 - protein, 7 aa, synthetic construct
GFTFSNY

SEQ ID NO: 2135 - protein, 7 aa, synthetic construct
GFTFSSY

SEQ ID NO: 2136 - protein, 7 aa, synthetic construct
GYTFTSY

SEQ ID NO: 2137 - protein, 7 aa, synthetic construct
GFTFSSY

SEQ ID NO: 2138 - protein, 7 aa, synthetic construct
GFTVSSN

SEQ ID NO: 2139 - protein, 7 aa, synthetic construct
GFTFDDY

SEQ ID NO: 2140 - protein, 7 aa, synthetic construct
GFTFSDY

SEQ ID NO: 2141 - protein, 7 aa, synthetic construct
GFTVSRN

SEQ ID NO: 2142 - protein, 7 aa, synthetic construct
GFTFSSY

SEQ ID NO: 2143 - protein, 7 aa, synthetic construct
GFTFSSY

SEQ ID NO: 2144 - protein, 7 aa, synthetic construct
GFTFSRY

SEQ ID NO: 2145 - protein, 7 aa, synthetic construct
GFTFSSY

SEQ ID NO: 2146 - protein, 7 aa, synthetic construct
GFTFSIY

SEQ ID NO: 2147 - protein, 7 aa, synthetic construct
GYTFTSY

SEQ ID NO: 2148 - protein, 7 aa, synthetic construct
GYTFTSY

SEQ ID NO: 2149 - protein, 7 aa, synthetic construct
GYTFTSY

SEQ ID NO: 2150 - protein, 7 aa, synthetic construct
GFTFSSY

SEQ ID NO: 2151 - protein, 7 aa, synthetic construct
GFTFSNA

SEQ ID NO: 2152 - protein, 7 aa, synthetic construct
GFTFSSH

SEQ ID NO: 2153 - protein, 7 aa, synthetic construct
GFTFSSY

SEQ ID NO: 2154 - protein, 7 aa, synthetic construct
GGSFSGY

SEQ ID NO: 2155 - protein, 7 aa, synthetic construct
GYTFTSY

SEQ ID NO: 2156 - protein, 7 aa, synthetic construct
GFTFSDY

SEQ ID NO: 2157 - protein, 7 aa, synthetic construct
GYSFTSY

SEQ ID NO: 2158 - protein, 7 aa, synthetic construct
GFTFSSY

SEQ ID NO: 2159 - protein, 9 aa, synthetic construct
GGSISSGGY

SEQ ID NO: 2160 - protein, 9 aa, synthetic construct
GFSLSTSGV

SEQ ID NO: 2161 - protein, 7 aa, synthetic construct
GFTFSSY

SEQ ID NO: 2162 - protein, 9 aa, synthetic construct
GFSLSTSGV

SEQ ID NO: 2163 - protein, 7 aa, synthetic construct
GYPFTSY

SEQ ID NO: 2164 - protein, 7 aa, synthetic construct
GYSFTGY

SEQ ID NO: 2165 - protein, 7 aa, synthetic construct
GYTFSSY

SEQ ID NO: 2166 - protein, 7 aa, synthetic construct
GYTFTGY

SEQ ID NO: 2167 - protein, 7 aa, synthetic construct
GYTFTSY

SEQ ID NO: 2168 - protein, 7 aa, synthetic construct
GYTFTSY

SEQ ID NO: 2169 - protein, 7 aa, synthetic construct
GDTFSNF

SEQ ID NO: 2170 - protein, 7 aa, synthetic construct
GFTFSNA

SEQ ID NO: 2171 - protein, 9 aa, synthetic construct
GDSVSSNSA

SEQ ID NO: 2172 - protein, 7 aa, synthetic construct
GFTFNNA

SEQ ID NO: 2173 - protein, 7 aa, synthetic construct
GFTFSNA

SEQ ID NO: 2174 - protein, 7 aa, synthetic construct
GFTFSSY

SEQ ID NO: 2175 - protein, 7 aa, synthetic construct
GFTFDDY

SEQ ID NO: 2176 - protein, 9 aa, synthetic construct
GDSVSSNSA

SEQ ID NO: 2177 - protein, 7 aa, synthetic construct
GFTFDDY

SEQ ID NO: 2178 - protein, 7 aa, synthetic construct
GFTFSSY

SEQ ID NO: 2179 - protein, 7 aa, synthetic construct
GYTFTSY

SEQ ID NO: 2180 - protein, 7 aa, synthetic construct
GFNFSSY

SEQ ID NO: 2181 - protein, 7 aa, synthetic construct
GFTFSNA

SEQ ID NO: 2182 - protein, 7 aa, synthetic construct
GFTFSSY

SEQ ID NO: 2183 - protein, 7 aa, synthetic construct
GFTFSSY

SEQ ID NO: 2184 - protein, 8 aa, synthetic construct
GGSISSNN

SEQ ID NO: 2185 - protein, 8 aa, synthetic construct
GGSISSSN

SEQ ID NO: 2186 - protein, 8 aa, synthetic construct
GGSIISSN

SEQ ID NO: 2187 - protein, 7 aa, synthetic construct
GFTFSSY

SEQ ID NO: 2188 - protein, 7 aa, synthetic construct
GFTFSSY

SEQ ID NO: 2189 - protein, 9 aa, synthetic construct
GFSLNSSGV

SEQ ID NO: 2190 - protein, 7 aa, synthetic construct
GYIFMNY

SEQ ID NO: 2191 - protein, 7 aa, synthetic construct
GYTFTNY

SEQ ID NO: 2192 - protein, 7 aa, synthetic construct
GYTFTDN

SEQ ID NO: 2193 - protein, 7 aa, synthetic construct
GYTFTSY

SEQ ID NO: 2194 - protein, 7 aa, synthetic construct
GFTFSSY

SEQ ID NO: 2195 - protein, 7 aa, synthetic construct
GFTFSNY

SEQ ID NO: 2196 - protein, 7 aa, synthetic construct
GFTFSSY

SEQ ID NO: 2197 - protein, 7 aa, synthetic construct
GYRFSNY

SEQ ID NO: 2198 - protein, 7 aa, synthetic construct
GYTFTSY

SEQ ID NO: 2199 - protein, 7 aa, synthetic construct
GFTFSSY

SEQ ID NO: 2200 - protein, 7 aa, synthetic construct
GYTFTGY

SEQ ID NO: 2201 - protein, 9 aa, synthetic construct
GDSVSSNSA

SEQ ID NO: 2202 - protein, 7 aa, synthetic construct
GYTFTSY

SEQ ID NO: 2203 - protein, 9 aa, synthetic construct
GFSITTSGV

SEQ ID NO: 2204 - protein, 9 aa, synthetic construct
GFSLSTSGV

SEQ ID NO: 2205 - protein, 7 aa, synthetic construct
GYTFTSY

SEQ ID NO: 2206 - protein, 9 aa, synthetic construct
GFSLSTSGM

SEQ ID NO: 2207 - protein, 7 aa, synthetic construct
GYTFTSY

SEQ ID NO: 2208 - protein, 7 aa, synthetic construct
GDTFTNC

SEQ ID NO: 2209 - protein, 7 aa, synthetic construct
GFTFDDY

SEQ ID NO: 2210 - protein, 7 aa, synthetic construct
GFTFSSY

SEQ ID NO: 2211 - protein, 7 aa, synthetic construct
GFTFSSY

SEQ ID NO: 2212 - protein, 7 aa, synthetic construct
GFTFSSY

SEQ ID NO: 2213 - protein, 7 aa, synthetic construct
GYTFTGY

SEQ ID NO: 2214 - protein, 7 aa, synthetic construct
GFTFSSY

SEQ ID NO: 2215 - protein, 7 aa, synthetic construct
GFTFSDY

SEQ ID NO: 2216 - protein, 7 aa, synthetic construct
GYTFNSY

SEQ ID NO: 2217 - protein, 9 aa, synthetic construct
GGSISRSSY

SEQ ID NO: 2218 - protein, 8 aa, synthetic construct
GGSISSSF

SEQ ID NO: 2219 - protein, 7 aa, synthetic construct
GFTFSNA

SEQ ID NO: 2220 - protein, 7 aa, synthetic construct
GGSISSY

SEQ ID NO: 2221 - protein, 7 aa, synthetic construct
GFTFSSY

SEQ ID NO: 2222 - protein, 7 aa, synthetic construct
GFTFGDF

SEQ ID NO: 2223 - protein, 9 aa, synthetic construct
GDSVSSNSA

SEQ ID NO: 2224 - protein, 7 aa, synthetic construct
GFTFSSY

SEQ ID NO: 2225 - protein, 9 aa, synthetic construct
GDSVSSNSA

SEQ ID NO: 2226 - protein, 7 aa, synthetic construct
GYTFTTY

SEQ ID NO: 2227 - protein, 7 aa, synthetic construct
GFTFDDY

SEQ ID NO: 2228 - protein, 9 aa, synthetic construct
GDSVSSNSA

SEQ ID NO: 2229 - protein, 7 aa, synthetic construct
AFTFSNY

SEQ ID NO: 2230 - protein, 7 aa, synthetic construct
GFTFSSY

SEQ ID NO: 2231 - protein, 7 aa, synthetic construct
GFTFSNA

SEQ ID NO: 2232 - protein, 7 aa, synthetic construct
GFTFSSH

SEQ ID NO: 2233 - protein, 7 aa, synthetic construct
GFTFSSY

SEQ ID NO: 2234 - protein, 9 aa, synthetic construct
GGSISSSSY

SEQ ID NO: 2235 - protein, 7 aa, synthetic construct
GYSFSSY

SEQ ID NO: 2236 - protein, 7 aa, synthetic construct
GFTFSNA

SEQ ID NO: 2237 - protein, 7 aa, synthetic construct
GFTFSTY

SEQ ID NO: 2238 - protein, 7 aa, synthetic construct
GFTFSNA

SEQ ID NO: 2239 - protein, 9 aa, synthetic construct
GGSITTRSY

SEQ ID NO: 2240 - protein, 9 aa, synthetic construct
GDSVSSNSA

SEQ ID NO: 2241 - protein, 7 aa, synthetic construct
GFTFDDY

SEQ ID NO: 2242 - protein, 7 aa, synthetic construct
GYTFTGN

SEQ ID NO: 2243 - protein, 7 aa, synthetic construct
GYTFTDY

SEQ ID NO: 2244 - protein, 9 aa, synthetic construct
GGSISSRSY

SEQ ID NO: 2245 - protein, 7 aa, synthetic construct
GFTFSGS

SEQ ID NO: 2246 - protein, 7 aa, synthetic construct
GGSFSGY

SEQ ID NO: 2247 - protein, 7 aa, synthetic construct
GGSFSGY

SEQ ID NO: 2248 - protein, 9 aa, synthetic construct
GGSISSSSY

SEQ ID NO: 2249 - protein, 9 aa, synthetic construct
GGSISSSSY

SEQ ID NO: 2250 - protein, 7 aa, synthetic construct
GFTFRSY

SEQ ID NO: 2251 - protein, 9 aa, synthetic construct
GGSINSSNF

SEQ ID NO: 2252 - protein, 9 aa, synthetic construct
GGSISSSSY

SEQ ID NO: 2253 - protein, 7 aa, synthetic construct
GGSFSGY

SEQ ID NO: 2254 - protein, 9 aa, synthetic construct
GGSISSSGY

SEQ ID NO: 2255 - protein, 7 aa, synthetic construct
GGSFSGY

SEQ ID NO: 2256 - protein, 7 aa, synthetic construct
YYRSKWY

SEQ ID NO: 2257 - protein, 7 aa, synthetic construct
YYRSKWY

SEQ ID NO: 2258 - protein, 6 aa, synthetic construct
NWNGGS

SEQ ID NO: 2259 - protein, 5 aa, synthetic construct
YYSGS

SEQ ID NO: 2260 - protein, 6 aa, synthetic construct
SSSSSY

SEQ ID NO: 2261 - protein, 6 aa, synthetic construct
SSSSSY

SEQ ID NO: 2262 - protein, 6 aa, synthetic construct
WYDGSN

SEQ ID NO: 2263 - protein, 6 aa, synthetic construct
SGSGGS

SEQ ID NO: 2264 - protein, 6 aa, synthetic construct
SPYNGN

SEQ ID NO: 2265 - protein, 5 aa, synthetic construct
NHSGS

SEQ ID NO: 2266 - protein, 6 aa, synthetic construct
WYDGSN

SEQ ID NO: 2267 - protein, 8 aa, synthetic construct
RSKPNNYA

SEQ ID NO: 2268 - protein, 6 aa, synthetic construct
NPNSGG

SEQ ID NO: 2269 - protein, 6 aa, synthetic construct
SAYSGN

SEQ ID NO: 2270 - protein, 6 aa, synthetic construct
WYDGSN

SEQ ID NO: 2271 - protein, 5 aa, synthetic construct
YHSGS

SEQ ID NO: 2272 - protein, 5 aa, synthetic construct
YWNDD

SEQ ID NO: 2273 - protein, 6 aa, synthetic construct
SGSGGS

SEQ ID NO: 2274 - protein, 8 aa, synthetic construct
KSKTDGGT

SEQ ID NO: 2275 - protein, 6 aa, synthetic construct
SSSSST

SEQ ID NO: 2276 - protein, 6 aa, synthetic construct
NWNGGS

SEQ ID NO: 2277 - protein, 6 aa, synthetic construct
YPSDSD

SEQ ID NO: 2278 - protein, 6 aa, synthetic construct
SVYNGN

SEQ ID NO: 2279 - protein, 7 aa, synthetic construct
YYRSKWY

SEQ ID NO: 2280 - protein, 5 aa, synthetic construct
NHSGS

SEQ ID NO: 2281 - protein, 6 aa, synthetic construct
SSSSSY

SEQ ID NO: 2282 - protein, 8 aa, synthetic construct
KSKTDGGT

SEQ ID NO: 2283 - protein, 5 aa, synthetic construct
YYIGI

SEQ ID NO: 2284 - protein, 5 aa, synthetic construct
YYSGS

SEQ ID NO: 2285 - protein, 8 aa, synthetic construct
KSKTDGGT

SEQ ID NO: 2286 - protein, 6 aa, synthetic construct
NPNSGN

SEQ ID NO: 2287 - protein, 6 aa, synthetic construct
SAYNGN

SEQ ID NO: 2288 - protein, 6 aa, synthetic construct
SGSGGS

SEQ ID NO: 2289 - protein, 8 aa, synthetic construct
KSKSDGGT

SEQ ID NO: 2290 - protein, 6 aa, synthetic construct
NPNSGN

SEQ ID NO: 2291 - protein, 8 aa, synthetic construct
KSKTDGGT

SEQ ID NO: 2292 - protein, 6 aa, synthetic construct
SSSSSY

SEQ ID NO: 2293 - protein, 6 aa, synthetic construct
NPNSGN

SEQ ID NO: 2294 - protein, 8 aa, synthetic construct
KSKTDGGT

SEQ ID NO: 2295 - protein, 6 aa, synthetic construct
SSSSSY

SEQ ID NO: 2296 - protein, 5 aa, synthetic construct
GTAGD

SEQ ID NO: 2297 - protein, 8 aa, synthetic construct
RSEIDGGT

SEQ ID NO: 2298 - protein, 8 aa, synthetic construct
KSKTDGGT

SEQ ID NO: 2299 - protein, 6 aa, synthetic construct
WYDGSN

SEQ ID NO: 2300 - protein, 6 aa, synthetic construct
SSSGST

SEQ ID NO: 2301 - protein, 6 aa, synthetic construct
NTYNDK

SEQ ID NO: 2302 - protein, 6 aa, synthetic construct
SAYNGN

SEQ ID NO: 2303 - protein, 5 aa, synthetic construct
GTAGD

SEQ ID NO: 2304 - protein, 8 aa, synthetic construct
KSKTDGGT

SEQ ID NO: 2305 - protein, 8 aa, synthetic construct
KSKTDGGT

SEQ ID NO: 2306 - protein, 6 aa, synthetic construct
SSSSSY

SEQ ID NO: 2307 - protein, 6 aa, synthetic construct
KQDGSE

SEQ ID NO: 2308 - protein, 6 aa, synthetic construct
NPSGGT

SEQ ID NO: 2309 - protein, 6 aa, synthetic construct
SSSSST

SEQ ID NO: 2310 - protein, 5 aa, synthetic construct
YSGGG

SEQ ID NO: 2311 - protein, 6 aa, synthetic construct
NWNGGS

SEQ ID NO: 2312 - protein, 5 aa, synthetic construct
YSGGS

SEQ ID NO: 2313 - protein, 6 aa, synthetic construct
SSSSSY

SEQ ID NO: 2314 - protein, 6 aa, synthetic construct
NSDGSS

SEQ ID NO: 2315 - protein, 5 aa, synthetic construct
YHSGS

SEQ ID NO: 2316 - protein, 6 aa, synthetic construct
NTNIGN

SEQ ID NO: 2317 - protein, 6 aa, synthetic construct
SSSSSY

SEQ ID NO: 2318 - protein, 6 aa, synthetic construct
SAYNGN

SEQ ID NO: 2319 - protein, 5 aa, synthetic construct
GTAGD

SEQ ID NO: 2320 - protein, 6 aa, synthetic construct
WYDGSN

SEQ ID NO: 2321 - protein, 6 aa, synthetic construct
YPGDSD

SEQ ID NO: 2322 - protein, 6 aa, synthetic construct
KYDGRE

SEQ ID NO: 2323 - protein, 6 aa, synthetic construct
KQDGSE

SEQ ID NO: 2324 - protein, 6 aa, synthetic construct
SAYNGN

SEQ ID NO: 2325 - protein, 6 aa, synthetic construct
NSDGSS

SEQ ID NO: 2326 - protein, 5 aa, synthetic construct
YSGGS

SEQ ID NO: 2327 - protein, 6 aa, synthetic construct
SWNSGS

SEQ ID NO: 2328 - protein, 6 aa, synthetic construct
SSSGST

SEQ ID NO: 2329 - protein, 5 aa, synthetic construct
YAGGN

SEQ ID NO: 2330 - protein, 6 aa, synthetic construct
KQDGSE

SEQ ID NO: 2331 - protein, 6 aa, synthetic construct
KQDGSE

SEQ ID NO: 2332 - protein, 6 aa, synthetic construct
NIVGST

SEQ ID NO: 2333 - protein, 6 aa, synthetic construct
SSSSSY

SEQ ID NO: 2334 - protein, 6 aa, synthetic construct
KEDGSE

SEQ ID NO: 2335 - protein, 6 aa, synthetic construct
SAYNGN

SEQ ID NO: 2336 - protein, 6 aa, synthetic construct
NPNSGN

SEQ ID NO: 2337 - protein, 6 aa, synthetic construct
NPSGGS

SEQ ID NO: 2338 - protein, 5 aa, synthetic construct
GTAGD

SEQ ID NO: 2339 - protein, 8 aa, synthetic construct
KSKTDGGT

SEQ ID NO: 2340 - protein, 6 aa, synthetic construct
SSNGGN

SEQ ID NO: 2341 - protein, 6 aa, synthetic construct
SSSSSY

SEQ ID NO: 2342 - protein, 5 aa, synthetic construct
NHSGS

SEQ ID NO: 2343 - protein, 6 aa, synthetic construct
NPSGGS

SEQ ID NO: 2344 - protein, 6 aa, synthetic construct
SSSGST

SEQ ID NO: 2345 - protein, 6 aa, synthetic construct
YPGDSD

SEQ ID NO: 2346 - protein, 6 aa, synthetic construct
SSSSST

SEQ ID NO: 2347 - protein, 5 aa, synthetic construct
FYSGS

SEQ ID NO: 2348 - protein, 5 aa, synthetic construct
YWNDD

SEQ ID NO: 2349 - protein, 6 aa, synthetic construct
SYDGSN

SEQ ID NO: 2350 - protein, 5 aa, synthetic construct
YWSDD

SEQ ID NO: 2351 - protein, 6 aa, synthetic construct
SAYNSN

SEQ ID NO: 2352 - protein, 6 aa, synthetic construct
SAYNGN

SEQ ID NO: 2353 - protein, 6 aa, synthetic construct
NTNTGN

SEQ ID NO: 2354 - protein, 6 aa, synthetic construct
NPNSGG

SEQ ID NO: 2355 - protein, 6 aa, synthetic construct
NPNSGN

SEQ ID NO: 2356 - protein, 6 aa, synthetic construct
NPNSGN

SEQ ID NO: 2357 - protein, 6 aa, synthetic construct
IPIFAT

SEQ ID NO: 2358 - protein, 8 aa, synthetic construct
KRKTDGGT

SEQ ID NO: 2359 - protein, 7 aa, synthetic construct
YYRSKWY

SEQ ID NO: 2360 - protein, 8 aa, synthetic construct
KSKTDGGT

SEQ ID NO: 2361 - protein, 8 aa, synthetic construct
KSKTDGGT

SEQ ID NO: 2362 - protein, 6 aa, synthetic construct
SYDGSN

SEQ ID NO: 2363 - protein, 6 aa, synthetic construct
NWNGGS

SEQ ID NO: 2364 - protein, 7 aa, synthetic construct
YYRSKWY

SEQ ID NO: 2365 - protein, 6 aa, synthetic construct
SWNSGS

SEQ ID NO: 2366 - protein, 6 aa, synthetic construct
SSSSNT

SEQ ID NO: 2367 - protein, 6 aa, synthetic construct
NPSGGS

SEQ ID NO: 2368 - protein, 6 aa, synthetic construct
SNTGNT

SEQ ID NO: 2369 - protein, 8 aa, synthetic construct
KRKTDGGT

SEQ ID NO: 2370 - protein, 6 aa, synthetic construct
NSDGSS

SEQ ID NO: 2371 - protein, 6 aa, synthetic construct
SGSGGS

SEQ ID NO: 2372 - protein, 5 aa, synthetic construct
YHSGS

SEQ ID NO: 2373 - protein, 5 aa, synthetic construct
YHSGS

SEQ ID NO: 2374 - protein, 5 aa, synthetic construct
YHSGS

SEQ ID NO: 2375 - protein, 6 aa, synthetic construct
SSSSSY

SEQ ID NO: 2376 - protein, 6 aa, synthetic construct
KQDGSE

SEQ ID NO: 2377 - protein, 5 aa, synthetic construct
YWNGD

SEQ ID NO: 2378 - protein, 6 aa, synthetic construct
SAYNGN

SEQ ID NO: 2379 - protein, 6 aa, synthetic construct
NTNTGK

SEQ ID NO: 2380 - protein, 6 aa, synthetic construct
NPNSGG

SEQ ID NO: 2381 - protein, 6 aa, synthetic construct
NPSGGS

SEQ ID NO: 2382 - protein, 6 aa, synthetic construct
SSSSST

SEQ ID NO: 2383 - protein, 6 aa, synthetic construct
SGSGGR

SEQ ID NO: 2384 - protein, 6 aa, synthetic construct
SYDGSN

SEQ ID NO: 2385 - protein, 6 aa, synthetic construct
YPGDSD

SEQ ID NO: 2386 - protein, 6 aa, synthetic construct
NTNTGN

SEQ ID NO: 2387 - protein, 6 aa, synthetic construct
WYDGSN

SEQ ID NO: 2388 - protein, 6 aa, synthetic construct
NPNSGG

SEQ ID NO: 2389 - protein, 7 aa, synthetic construct
YYRSKWY

SEQ ID NO: 2390 - protein, 6 aa, synthetic construct
SAYNGN

SEQ ID NO: 2391 - protein, 5 aa, synthetic construct
YWNDD

SEQ ID NO: 2392 - protein, 5 aa, synthetic construct
YWNDD

SEQ ID NO: 2393 - protein, 6 aa, synthetic construct
NPNSGN

SEQ ID NO: 2394 - protein, 5 aa, synthetic construct
DWDDD

SEQ ID NO: 2395 - protein, 6 aa, synthetic construct
SGYKGN

SEQ ID NO: 2396 - protein, 6 aa, synthetic construct
SAYNGN

SEQ ID NO: 2397 - protein, 6 aa, synthetic construct
SKNSGS

SEQ ID NO: 2398 - protein, 6 aa, synthetic construct
SSSSST

SEQ ID NO: 2399 - protein, 6 aa, synthetic construct
SGSGGS

SEQ ID NO: 2400 - protein, 6 aa, synthetic construct
WYDGSN

SEQ ID NO: 2401 - protein, 6 aa, synthetic construct
NPNSGG

SEQ ID NO: 2402 - protein, 6 aa, synthetic construct
SSSSST

SEQ ID NO: 2403 - protein, 6 aa, synthetic construct
SSSGST

SEQ ID NO: 2404 - protein, 6 aa, synthetic construct
NTNTGN

SEQ ID NO: 2405 - protein, 5 aa, synthetic construct
YYSGS

SEQ ID NO: 2406 - protein, 5 aa, synthetic construct
YHSGS

SEQ ID NO: 2407 - protein, 8 aa, synthetic construct
KSKSDGET

SEQ ID NO: 2408 - protein, 5 aa, synthetic construct
YYSGS

SEQ ID NO: 2409 - protein, 6 aa, synthetic construct
SGSGGS

SEQ ID NO: 2410 - protein, 6 aa, synthetic construct
NWNGGS

SEQ ID NO: 2411 - protein, 7 aa, synthetic construct
YYRSKWY

SEQ ID NO: 2412 - protein, 6 aa, synthetic construct
SSSSST

SEQ ID NO: 2413 - protein, 7 aa, synthetic construct
YYMSKWY

SEQ ID NO: 2414 - protein, 6 aa, synthetic construct
SAYNGN

SEQ ID NO: 2415 - protein, 6 aa, synthetic construct
NWNGGS

SEQ ID NO: 2416 - protein, 7 aa, synthetic construct
YYRSKWY

SEQ ID NO: 2417 - protein, 6 aa, synthetic construct
SSSTSY

SEQ ID NO: 2418 - protein, 6 aa, synthetic construct
SSSSSY

SEQ ID NO: 2419 - protein, 8 aa, synthetic construct
KSKTDGGT

SEQ ID NO: 2420 - protein, 6 aa, synthetic construct
SGSESS

SEQ ID NO: 2421 - protein, 6 aa, synthetic construct
WYDGSN

SEQ ID NO: 2422 - protein, 5 aa, synthetic construct
HYSGS

SEQ ID NO: 2423 - protein, 6 aa, synthetic construct
SGYNGN

SEQ ID NO: 2424 - protein, 8 aa, synthetic construct
KSKTDGGT

SEQ ID NO: 2425 - protein, 6 aa, synthetic construct
SSGSST

SEQ ID NO: 2426 - protein, 8 aa, synthetic construct
KSKTDGGT

SEQ ID NO: 2427 - protein, 5 aa, synthetic construct
YYSGN

SEQ ID NO: 2428 - protein, 7 aa, synthetic construct
YYRSKWY

SEQ ID NO: 2429 - protein, 6 aa, synthetic construct
NWNGGS

SEQ ID NO: 2430 - protein, 6 aa, synthetic construct
NPTSGV

SEQ ID NO: 2431 - protein, 6 aa, synthetic construct
NPNSGG

SEQ ID NO: 2432 - protein, 5 aa, synthetic construct
FYSGS

SEQ ID NO: 2433 - protein, 8 aa, synthetic construct
RSKANSYA

SEQ ID NO: 2434 - protein, 5 aa, synthetic construct
NHSGS

SEQ ID NO: 2435 - protein, 5 aa, synthetic construct
NRSGS

SEQ ID NO: 2436 - protein, 5 aa, synthetic construct
YYSGS

SEQ ID NO: 2437 - protein, 5 aa, synthetic construct
YYSGS

SEQ ID NO: 2438 - protein, 6 aa, synthetic construct
NQDGSE

SEQ ID NO: 2439 - protein, 5 aa, synthetic construct
FYSGF

SEQ ID NO: 2440 - protein, 5 aa, synthetic construct
YYSGS

SEQ ID NO: 2441 - protein, 5 aa, synthetic construct
NRGGS

SEQ ID NO: 2442 - protein, 5 aa, synthetic construct
YYSGS

SEQ ID NO: 2443 - protein, 5 aa, synthetic construct
NHSGS

SEQ ID NO: 2444 - protein, 14 aa, synthetic construct
TGTSSDVGGYNYVS

SEQ ID NO: 2445 - protein, 14 aa, synthetic construct
TGTSSDVGGYNYVS

SEQ ID NO: 2446 - protein, 11 aa, synthetic construct
SGDKLGDKYAC

SEQ ID NO: 2447 - protein, 11 aa, synthetic construct
SGDVLAKKYAR

SEQ ID NO: 2448 - protein, 11 aa, synthetic construct
QGDSLRSYYAS

SEQ ID NO: 2449 - protein, 14 aa, synthetic construct
TGTSSDVGGYNYVS

SEQ ID NO: 2450 - protein, 14 aa, synthetic construct
TGTSSDVGGYNYVS

SEQ ID NO: 2451 - protein, 14 aa, synthetic construct
TGTSSDVGGYNYVS

SEQ ID NO: 2452 - protein, 14 aa, synthetic construct
TGTSSDVGGYNYVS

SEQ ID NO: 2453 - protein, 11 aa, synthetic construct
QGDSLRSYYAS

SEQ ID NO: 2454 - protein, 11 aa, synthetic construct
GGNNIGSKSVH

SEQ ID NO: 2455 - protein, 14 aa, synthetic construct
TLRSGINVGTYRIY

SEQ ID NO: 2456 - protein, 11 aa, synthetic construct
QGDSLRSYYAS

SEQ ID NO: 2457 - protein, 11 aa, synthetic construct
SGDALPKKYAY

SEQ ID NO: 2458 - protein, 14 aa, synthetic construct
TGTSSDVGGYNYVS

SEQ ID NO: 2459 - protein, 14 aa, synthetic construct
TLRSGINVGTYRIY

SEQ ID NO: 2460 - protein, 11 aa, synthetic construct
SGDKLGDKYAC

SEQ ID NO: 2461 - protein, 11 aa, synthetic construct
SGDALPKKYAY

SEQ ID NO: 2462 - protein, 11 aa, synthetic construct
QGDSLRSYYAS

SEQ ID NO: 2463 - protein, 14 aa, synthetic construct
TGTSSDVGGYNYVS

SEQ ID NO: 2464 - protein, 14 aa, synthetic construct
TGTSSDVGGYNYVS

SEQ ID NO: 2465 - protein, 14 aa, synthetic construct
TGTSSDVGGYNYVS

SEQ ID NO: 2466 - protein, 14 aa, synthetic construct
TGTSSDVGGYNYVS

SEQ ID NO: 2467 - protein, 14 aa, synthetic construct
TGTSSDVGGYNYVS

SEQ ID NO: 2468 - protein, 12 aa, synthetic construct
TLSSEHSTYTIE

SEQ ID NO: 2469 - protein, 12 aa, synthetic construct
TLSSEHSTYTIE

SEQ ID NO: 2470 - protein, 11 aa, synthetic construct
QGDSLRSYYAS

SEQ ID NO: 2471 - protein, 11 aa, synthetic construct
GGNNVGSKSVH

SEQ ID NO: 2472 - protein, 11 aa, synthetic construct
GGNTFGSKTVH

SEQ ID NO: 2473 - protein, 11 aa, synthetic construct
SGDALPKKYAY

SEQ ID NO: 2474 - protein, 14 aa, synthetic construct
TGTSSDVGGYNYVS

SEQ ID NO: 2475 - protein, 14 aa, synthetic construct
TGTSSDVGGYNYVS

SEQ ID NO: 2476 - protein, 13 aa, synthetic construct
SGSSSNIGSNTVN

SEQ ID NO: 2477 - protein, 11 aa, synthetic construct
SADALPKQYAY

SEQ ID NO: 2478 - protein, 11 aa, synthetic construct
SGDALPKKYAY

SEQ ID NO: 2479 - protein, 11 aa, synthetic construct
SADALPKQYAY

SEQ ID NO: 2480 - protein, 11 aa, synthetic construct
SGDKLGDKYAC

SEQ ID NO: 2481 - protein, 11 aa, synthetic construct
SGDKLGDKYAC

SEQ ID NO: 2482 - protein, 11 aa, synthetic construct
SGDKLGDKYAC

SEQ ID NO: 2483 - protein, 11 aa, synthetic construct
QGDSLRSYYAS

SEQ ID NO: 2484 - protein, 14 aa, synthetic construct
TGTSSDVGGYNYVS

SEQ ID NO: 2485 - protein, 11 aa, synthetic construct
QGDSLRSYYAS

SEQ ID NO: 2486 - protein, 11 aa, synthetic construct
QGDSLRSYYAS

SEQ ID NO: 2487 - protein, 13 aa, synthetic construct
SGSSSNIGNNAVN

SEQ ID NO: 2488 - protein, 14 aa, synthetic construct
TGTSSDVGGYNYVS

SEQ ID NO: 2489 - protein, 11 aa, synthetic construct
SGDKLGDKHAC

SEQ ID NO: 2490 - protein, 11 aa, synthetic construct
SGDVLAKKYAR

SEQ ID NO: 2491 - protein, 11 aa, synthetic construct
SGDVLAKKYAR

SEQ ID NO: 2492 - protein, 11 aa, synthetic construct
SGDVLAKKYAR

SEQ ID NO: 2493 - protein, 11 aa, synthetic construct
SGDVLAKKYAR

SEQ ID NO: 2494 - protein, 11 aa, synthetic construct
QGDRLRSYYAS

SEQ ID NO: 2495 - protein, 11 aa, synthetic construct
QGDSLRSYYAS

SEQ ID NO: 2496 - protein, 11 aa, synthetic construct
GGNNIGSKSVH

SEQ ID NO: 2497 - protein, 11 aa, synthetic construct
SGDALPKKYAY

SEQ ID NO: 2498 - protein, 14 aa, synthetic construct
ASSTGAVTSGYYPN

SEQ ID NO: 2499 - protein, 14 aa, synthetic construct
TGTSSDVGGYNYVS

SEQ ID NO: 2500 - protein, 14 aa, synthetic construct
TGTSSDVGGYNYVS

SEQ ID NO: 2501 - protein, 14 aa, synthetic construct
TGTSSDVGGYNYVS

SEQ ID NO: 2502 - protein, 11 aa, synthetic construct
SGDKLGDKYAC

SEQ ID NO: 2503 - protein, 11 aa, synthetic construct
SGDKLGDKYAC

SEQ ID NO: 2504 - protein, 11 aa, synthetic construct
SGDKLGDKYAC

SEQ ID NO: 2505 - protein, 11 aa, synthetic construct
QGDSLRSYYAS

SEQ ID NO: 2506 - protein, 11 aa, synthetic construct
SGDALPKKYAY

SEQ ID NO: 2507 - protein, 11 aa, synthetic construct
QGDSLRSYYAS

SEQ ID NO: 2508 - protein, 11 aa, synthetic construct
SGDALPKKYAY

SEQ ID NO: 2509 - protein, 11 aa, synthetic construct
GGNNIGSKSVH

SEQ ID NO: 2510 - protein, 13 aa, synthetic construct
SGSISNLGSNTVN

SEQ ID NO: 2511 - protein, 14 aa, synthetic construct
TGTSSDVGGYNYVS

SEQ ID NO: 2512 - protein, 14 aa, synthetic construct
TGTSSDVGGYNYVS

SEQ ID NO: 2513 - protein, 14 aa, synthetic construct
TGTSSDVGGYNYVS

SEQ ID NO: 2514 - protein, 14 aa, synthetic construct
TGTSSDVGGYNYVS

SEQ ID NO: 2515 - protein, 14 aa, synthetic construct
TGTSSDVGGYNYVS

SEQ ID NO: 2516 - protein, 14 aa, synthetic construct
TGSSSNIGAGYDVH

SEQ ID NO: 2517 - protein, 14 aa, synthetic construct
TGSSSNIGAGYDVH

SEQ ID NO: 2518 - protein, 14 aa, synthetic construct
TLRSGINVGTYRIY

SEQ ID NO: 2519 - protein, 14 aa, synthetic construct
TLRSGINVGTYRIY

SEQ ID NO: 2520 - protein, 11 aa, synthetic construct
RGNNIGSQNVH

SEQ ID NO: 2521 - protein, 11 aa, synthetic construct
SGDALPKKYAY

SEQ ID NO: 2522 - protein, 11 aa, synthetic construct
QGDSLRSFYAS

SEQ ID NO: 2523 - protein, 11 aa, synthetic construct
QGDSLRSYYAS

SEQ ID NO: 2524 - protein, 11 aa, synthetic construct
SGDALPKKYAY

SEQ ID NO: 2525 - protein, 11 aa, synthetic construct
QGDSLRSYYAS

SEQ ID NO: 2526 - protein, 11 aa, synthetic construct
SGDALPKKYAY

SEQ ID NO: 2527 - protein, 14 aa, synthetic construct
ASSTGAVTSGYYPN

SEQ ID NO: 2528 - protein, 14 aa, synthetic construct
TGTSSDVGGYNYVS

SEQ ID NO: 2529 - protein, 13 aa, synthetic construct
SGSSSNIGSNTVN

SEQ ID NO: 2530 - protein, 14 aa, synthetic construct
TGTSSDVGGYNYVS

SEQ ID NO: 2531 - protein, 14 aa, synthetic construct
TGTSSDVGGYNYVS

SEQ ID NO: 2532 - protein, 14 aa, synthetic construct
TGTSSDVGGYNYVS

SEQ ID NO: 2533 - protein, 14 aa, synthetic construct
TGTSSDVGGYNYVS

SEQ ID NO: 2534 - protein, 14 aa, synthetic construct
TLRSGINVGTYRIY

SEQ ID NO: 2535 - protein, 11 aa, synthetic construct
SGDKLGDKYAC

SEQ ID NO: 2536 - protein, 11 aa, synthetic construct
SADALPKQYAY

SEQ ID NO: 2537 - protein, 11 aa, synthetic construct
SGDKLGDKYAC

SEQ ID NO: 2538 - protein, 11 aa, synthetic construct
SADALPNQYAY

SEQ ID NO: 2539 - protein, 11 aa, synthetic construct
QGDSLRSYYAS

SEQ ID NO: 2540 - protein, 11 aa, synthetic construct
SGDALPKKYAY

SEQ ID NO: 2541 - protein, 11 aa, synthetic construct
QGDSLRSYYAS

SEQ ID NO: 2542 - protein, 11 aa, synthetic construct
SGDALPKKYAY

SEQ ID NO: 2543 - protein, 11 aa, synthetic construct
SGDALPKKYAY

SEQ ID NO: 2544 - protein, 11 aa, synthetic construct
SGDALPKKYAY

SEQ ID NO: 2545 - protein, 11 aa, synthetic construct
GGNNIGSKSVH

SEQ ID NO: 2546 - protein, 11 aa, synthetic construct
SADALPKQYAY

SEQ ID NO: 2547 - protein, 11 aa, synthetic construct
QGDSLRSYYAS

SEQ ID NO: 2548 - protein, 14 aa, synthetic construct
GSSTGAVTSGHYPY

SEQ ID NO: 2549 - protein, 14 aa, synthetic construct
TGTSSDVGGYNYVS

SEQ ID NO: 2550 - protein, 14 aa, synthetic construct
TGTSSDVGGYNYVS

SEQ ID NO: 2551 - protein, 14 aa, synthetic construct
TGTSSDVGGYNYVS

SEQ ID NO: 2552 - protein, 14 aa, synthetic construct
TGTSSDVGGYNYVS

SEQ ID NO: 2553 - protein, 14 aa, synthetic construct
TGTSSDVGGYNYVS

SEQ ID NO: 2554 - protein, 14 aa, synthetic construct
TGTSSDVGGYNYVS

SEQ ID NO: 2555 - protein, 11 aa, synthetic construct
SGDKLGDKYAC

SEQ ID NO: 2556 - protein, 11 aa, synthetic construct
SGDVLAKKYAR

SEQ ID NO: 2557 - protein, 11 aa, synthetic construct
SGDKLGDKYAC

SEQ ID NO: 2558 - protein, 11 aa, synthetic construct
SGDKLGDKYAC

SEQ ID NO: 2559 - protein, 11 aa, synthetic construct
SGDALPKKYAY

SEQ ID NO: 2560 - protein, 11 aa, synthetic construct
SGDALPKKYAY

SEQ ID NO: 2561 - protein, 14 aa, synthetic construct
TGTSSDVGGYNYVS

SEQ ID NO: 2562 - protein, 11 aa, synthetic construct
QGDSLRSYYAS

SEQ ID NO: 2563 - protein, 11 aa, synthetic construct
QGDSLRSYYAS

SEQ ID NO: 2564 - protein, 11 aa, synthetic construct
QGDSLRSYYAS

SEQ ID NO: 2565 - protein, 11 aa, synthetic construct
GGNNIGSKSVH

SEQ ID NO: 2566 - protein, 11 aa, synthetic construct
QGDSLRSYYAS

SEQ ID NO: 2567 - protein, 11 aa, synthetic construct
QGDSLRSYYAS

SEQ ID NO: 2568 - protein, 11 aa, synthetic construct
QGDSLRSYYAS

SEQ ID NO: 2569 - protein, 11 aa, synthetic construct
QGDSLRSYYAS

SEQ ID NO: 2570 - protein, 11 aa, synthetic construct
SGDALPKKYAY

SEQ ID NO: 2571 - protein, 11 aa, synthetic construct
QGDSFRNYYAS

SEQ ID NO: 2572 - protein, 11 aa, synthetic construct
QGDSLRSYYAS

SEQ ID NO: 2573 - protein, 11 aa, synthetic construct
QGDSLRSYYAS

SEQ ID NO: 2574 - protein, 14 aa, synthetic construct
ASSTGAVTSGYYPN

SEQ ID NO: 2575 - protein, 14 aa, synthetic construct
TGTSSDVGVYNFVS

SEQ ID NO: 2576 - protein, 14 aa, synthetic construct
TGSSSNIGAGYDVH

SEQ ID NO: 2577 - protein, 14 aa, synthetic construct
TGTSSDVGGYNYVS

SEQ ID NO: 2578 - protein, 14 aa, synthetic construct
TGSSSNIGAGYDVH

SEQ ID NO: 2579 - protein, 14 aa, synthetic construct
TLRSGIHVDTSRIY

SEQ ID NO: 2580 - protein, 14 aa, synthetic construct
TLRSGINVGSYRIY

SEQ ID NO: 2581 - protein, 14 aa, synthetic construct
TLRSGINVGTYRIY

SEQ ID NO: 2582 - protein, 11 aa, synthetic construct
QGDSLRSYYAS

SEQ ID NO: 2583 - protein, 11 aa, synthetic construct
QGDSLRSYYAS

SEQ ID NO: 2584 - protein, 11 aa, synthetic construct
QGDSLRSYYAS

SEQ ID NO: 2585 - protein, 11 aa, synthetic construct
QGDSLRSYYAS

SEQ ID NO: 2586 - protein, 11 aa, synthetic construct
QGDSLRSYYAS

SEQ ID NO: 2587 - protein, 11 aa, synthetic construct
QGDSLRSYYAS

SEQ ID NO: 2588 - protein, 11 aa, synthetic construct
SGDALPKKYAY

SEQ ID NO: 2589 - protein, 14 aa, synthetic construct
TGTSSDVGGYNYVS

SEQ ID NO: 2590 - protein, 14 aa, synthetic construct
TGTSSDVGGYNYVS

SEQ ID NO: 2591 - protein, 14 aa, synthetic construct
ASSTGAVTSGYYPN

SEQ ID NO: 2592 - protein, 14 aa, synthetic construct
TGSNSNIGAGYDIH

SEQ ID NO: 2593 - protein, 11 aa, synthetic construct
SGDVLAKKFAR

SEQ ID NO: 2594 - protein, 11 aa, synthetic construct
SGDALPKKYAY

SEQ ID NO: 2595 - protein, 11 aa, synthetic construct
GGNNFGSKSVH

SEQ ID NO: 2596 - protein, 14 aa, synthetic construct
TGTSSDVGAYNYVS

SEQ ID NO: 2597 - protein, 14 aa, synthetic construct
TGTSSDVGGYNYVS

SEQ ID NO: 2598 - protein, 14 aa, synthetic construct
TGTSSDVGGYNYVS

SEQ ID NO: 2599 - protein, 14 aa, synthetic construct
TGTSSDVGGYNYVS

SEQ ID NO: 2600 - protein, 14 aa, synthetic construct
TGSSSNIGAGYDVH

SEQ ID NO: 2601 - protein, 14 aa, synthetic construct
TGTSSDVGSYNRVS

SEQ ID NO: 2602 - protein, 14 aa, synthetic construct
TGSDSNIGAGYDVH

SEQ ID NO: 2603 - protein, 11 aa, synthetic construct
SGDKLGDKYAC

SEQ ID NO: 2604 - protein, 11 aa, synthetic construct
SGDGLSKKYAY

SEQ ID NO: 2605 - protein, 11 aa, synthetic construct
QGDSLRSYYAS

SEQ ID NO: 2606 - protein, 11 aa, synthetic construct
QGDSLRSYYAS

SEQ ID NO: 2607 - protein, 11 aa, synthetic construct
SGDALPKKYAY

SEQ ID NO: 2608 - protein, 11 aa, synthetic construct
QGDSLRSYYAS

SEQ ID NO: 2609 - protein, 11 aa, synthetic construct
QGDSLRSYYAS

SEQ ID NO: 2610 - protein, 11 aa, synthetic construct
QGDSLRSYYAS

SEQ ID NO: 2611 - protein, 14 aa, synthetic construct
TGTSSDVGGYNYVS

SEQ ID NO: 2612 - protein, 14 aa, synthetic construct
TGTSSDVGGYNYVS

SEQ ID NO: 2613 - protein, 11 aa, synthetic construct
QGDSLRSYYAT

SEQ ID NO: 2614 - protein, 11 aa, synthetic construct
GGNNIGSKSVH

SEQ ID NO: 2615 - protein, 11 aa, synthetic construct
QGDSLRSYYAS

SEQ ID NO: 2616 - protein, 11 aa, synthetic construct
QGDSLRSYYAS

SEQ ID NO: 2617 - protein, 14 aa, synthetic construct
TGTSSDVGGYNYVS

SEQ ID NO: 2618 - protein, 14 aa, synthetic construct
TGSSSNIGARYDVH

SEQ ID NO: 2619 - protein, 11 aa, synthetic construct
QGDSLRSYYAS

SEQ ID NO: 2620 - protein, 14 aa, synthetic construct
TGTSSDVGGYNYVS

SEQ ID NO: 2621 - protein, 11 aa, synthetic construct
SGDKLGDKYAC

SEQ ID NO: 2622 - protein, 11 aa, synthetic construct
SGDALPKKYAY

SEQ ID NO: 2623 - protein, 11 aa, synthetic construct
QGDSLRNYYAS

SEQ ID NO: 2624 - protein, 14 aa, synthetic construct
TGTSSDVGGYNYVS

SEQ ID NO: 2625 - protein, 11 aa, synthetic construct
QGDSLRTYYAS

SEQ ID NO: 2626 - protein, 11 aa, synthetic construct
GGDNIGIKNVH

SEQ ID NO: 2627 - protein, 11 aa, synthetic construct
SGDKLGDKYTC

SEQ ID NO: 2628 - protein, 11 aa, synthetic construct
QGDSLRSYYAS

SEQ ID NO: 2629 - protein, 14 aa, synthetic construct
TGTSSDVGGYNYVS

SEQ ID NO: 2630 - protein, 14 aa, synthetic construct
TGTSSDVGGYNYVS

SEQ ID NO: 2631 - protein, 14 aa, synthetic construct
GSSTGAVTSGHYPY

SEQ ID NO: 2632 - protein, 7 aa, synthetic construct
EVSNRPS

SEQ ID NO: 2633 - protein, 7 aa, synthetic construct
DVSKRPS

SEQ ID NO: 2634 - protein, 7 aa, synthetic construct
QDSKRPS

SEQ ID NO: 2635 - protein, 7 aa, synthetic construct
KDSERPS

SEQ ID NO: 2636 - protein, 7 aa, synthetic construct
GKNNRPS

SEQ ID NO: 2637 - protein, 7 aa, synthetic construct
DVSKRPS

SEQ ID NO: 2638 - protein, 7 aa, synthetic construct
EVSKRPS

SEQ ID NO: 2639 - protein, 7 aa, synthetic construct
EVSNRPS

SEQ ID NO: 2640 - protein, 7 aa, synthetic construct
DVSKRPS

SEQ ID NO: 2641 - protein, 7 aa, synthetic construct
GKNNRPS

SEQ ID NO: 2642 - protein, 7 aa, synthetic construct
YDSDRPS

SEQ ID NO: 2643 - protein, 11 aa, synthetic construct
YKSDSDKQQGS

SEQ ID NO: 2644 - protein, 7 aa, synthetic construct
GKNNRPS

SEQ ID NO: 2645 - protein, 7 aa, synthetic construct
EDSKRPS

SEQ ID NO: 2646 - protein, 7 aa, synthetic construct
EVSNRPS

SEQ ID NO: 2647 - protein, 11 aa, synthetic construct
YKSDSDKQQGS

SEQ ID NO: 2648 - protein, 7 aa, synthetic construct
QDSKRPS

SEQ ID NO: 2649 - protein, 7 aa, synthetic construct
EDSKRPS

SEQ ID NO: 2650 - protein, 7 aa, synthetic construct
GKNNRPS

SEQ ID NO: 2651 - protein, 7 aa, synthetic construct
DVSKRPS

SEQ ID NO: 2652 - protein, 7 aa, synthetic construct
EVSNRPS

SEQ ID NO: 2653 - protein, 7 aa, synthetic construct
DVSKRPS

SEQ ID NO: 2654 - protein, 7 aa, synthetic construct
DVSKRPS

SEQ ID NO: 2655 - protein, 7 aa, synthetic construct
DVSKRPS

SEQ ID NO: 2656 - protein, 11 aa, synthetic construct
VKSDGSHSKGD

SEQ ID NO: 2657 - protein, 11 aa, synthetic construct
VKSDGSHSKGD

SEQ ID NO: 2658 - protein, 7 aa, synthetic construct
GKNNRPS

SEQ ID NO: 2659 - protein, 7 aa, synthetic construct
YDTDRPS

SEQ ID NO: 2660 - protein, 7 aa, synthetic construct
YDSDRPS

SEQ ID NO: 2661 - protein, 7 aa, synthetic construct
EDSKRPS

SEQ ID NO: 2662 - protein, 7 aa, synthetic construct
EVSNRPS

SEQ ID NO: 2663 - protein, 7 aa, synthetic construct
EVIKRPS

SEQ ID NO: 2664 - protein, 7 aa, synthetic construct
SNNQRPS

SEQ ID NO: 2665 - protein, 7 aa, synthetic construct
KDSERPS

SEQ ID NO: 2666 - protein, 7 aa, synthetic construct
EDSKRPS

SEQ ID NO: 2667 - protein, 7 aa, synthetic construct
KDSERPS

SEQ ID NO: 2668 - protein, 7 aa, synthetic construct
QDSKRPS

SEQ ID NO: 2669 - protein, 7 aa, synthetic construct
QDSKRPS

SEQ ID NO: 2670 - protein, 7 aa, synthetic construct
QDSKRPS

SEQ ID NO: 2671 - protein, 7 aa, synthetic construct
GKNNRPS

SEQ ID NO: 2672 - protein, 7 aa, synthetic construct
DVSKRPS

SEQ ID NO: 2673 - protein, 7 aa, synthetic construct
GKNNRPS

SEQ ID NO: 2674 - protein, 7 aa, synthetic construct
GKNNRPS

SEQ ID NO: 2675 - protein, 7 aa, synthetic construct
YDDLLPS

SEQ ID NO: 2676 - protein, 7 aa, synthetic construct
DVSKRPS

SEQ ID NO: 2677 - protein, 7 aa, synthetic construct
QDSKRPS

SEQ ID NO: 2678 - protein, 7 aa, synthetic construct
KDSERPS

SEQ ID NO: 2679 - protein, 7 aa, synthetic construct
KDSERPS

SEQ ID NO: 2680 - protein, 7 aa, synthetic construct
KDSERPS

SEQ ID NO: 2681 - protein, 7 aa, synthetic construct
KDSERPS

SEQ ID NO: 2682 - protein, 7 aa, synthetic construct
GKNNRPS

SEQ ID NO: 2683 - protein, 7 aa, synthetic construct
GKNNRPS

SEQ ID NO: 2684 - protein, 7 aa, synthetic construct
YDSDRPS

SEQ ID NO: 2685 - protein, 7 aa, synthetic construct
EDSKRPS

SEQ ID NO: 2686 - protein, 7 aa, synthetic construct
STSNKHS

SEQ ID NO: 2687 - protein, 7 aa, synthetic construct
EVSKRPS

SEQ ID NO: 2688 - protein, 7 aa, synthetic construct
DVSKRPS

SEQ ID NO: 2689 - protein, 7 aa, synthetic construct
DVSKRPS

SEQ ID NO: 2690 - protein, 7 aa, synthetic construct
QDSKRPS

SEQ ID NO: 2691 - protein, 7 aa, synthetic construct
QDNKRPS

SEQ ID NO: 2692 - protein, 7 aa, synthetic construct
QDSKRPS

SEQ ID NO: 2693 - protein, 7 aa, synthetic construct
GKNNRPS

SEQ ID NO: 2694 - protein, 7 aa, synthetic construct
EDSKRPS

SEQ ID NO: 2695 - protein, 7 aa, synthetic construct
GKNNRPS

SEQ ID NO: 2696 - protein, 7 aa, synthetic construct
EDSKRPS

SEQ ID NO: 2697 - protein, 7 aa, synthetic construct
YDSDRPS

SEQ ID NO: 2698 - protein, 7 aa, synthetic construct
SNNQRPS

SEQ ID NO: 2699 - protein, 7 aa, synthetic construct
EVSKRPS

SEQ ID NO: 2700 - protein, 7 aa, synthetic construct
EVSKRPS

SEQ ID NO: 2701 - protein, 7 aa, synthetic construct
DVSKRPS

SEQ ID NO: 2702 - protein, 7 aa, synthetic construct
DVSKRPS

SEQ ID NO: 2703 - protein, 7 aa, synthetic construct
EVSKRPS

SEQ ID NO: 2704 - protein, 7 aa, synthetic construct
GNSNRPS

SEQ ID NO: 2705 - protein, 7 aa, synthetic construct
GNNNRPS

SEQ ID NO: 2706 - protein, 11 aa, synthetic construct
YKSDSDKQQGS

SEQ ID NO: 2707 - protein, 11 aa, synthetic construct
YKSDSDKQQGS

SEQ ID NO: 2708 - protein, 7 aa, synthetic construct
RNINRPS

SEQ ID NO: 2709 - protein, 7 aa, synthetic construct
EDSKRPS

SEQ ID NO: 2710 - protein, 7 aa, synthetic construct
GKSNRPS

SEQ ID NO: 2711 - protein, 7 aa, synthetic construct
GKNNRPS

SEQ ID NO: 2712 - protein, 7 aa, synthetic construct
EDSKRPS

SEQ ID NO: 2713 - protein, 7 aa, synthetic construct
GKNNRPS

SEQ ID NO: 2714 - protein, 7 aa, synthetic construct
EDSKRPS

SEQ ID NO: 2715 - protein, 7 aa, synthetic construct
STSNKHS

SEQ ID NO: 2716 - protein, 7 aa, synthetic construct
EVSNRPS

SEQ ID NO: 2717 - protein, 7 aa, synthetic construct
SNNQRPS

SEQ ID NO: 2718 - protein, 7 aa, synthetic construct
EVSKRPS

SEQ ID NO: 2719 - protein, 7 aa, synthetic construct
DVSKRPS

SEQ ID NO: 2720 - protein, 7 aa, synthetic construct
DVSKRPS

SEQ ID NO: 2721 - protein, 7 aa, synthetic construct
EVSKRPS

SEQ ID NO: 2722 - protein, 11 aa, synthetic construct
YKSDSDKQQGS

SEQ ID NO: 2723 - protein, 7 aa, synthetic construct
QDSKRPS

SEQ ID NO: 2724 - protein, 7 aa, synthetic construct
KDSERPS

SEQ ID NO: 2725 - protein, 7 aa, synthetic construct
QDTKRPS

SEQ ID NO: 2726 - protein, 7 aa, synthetic construct
KDSERPS

SEQ ID NO: 2727 - protein, 7 aa, synthetic construct
GKNNRPS

SEQ ID NO: 2728 - protein, 7 aa, synthetic construct
EDSKRPS

SEQ ID NO: 2729 - protein, 7 aa, synthetic construct
GKNNRPS

SEQ ID NO: 2730 - protein, 7 aa, synthetic construct
EDSKRPS

SEQ ID NO: 2731 - protein, 7 aa, synthetic construct
EDSKRPS

SEQ ID NO: 2732 - protein, 7 aa, synthetic construct
EDSKRPS

SEQ ID NO: 2733 - protein, 7 aa, synthetic construct
YDSDRPS

SEQ ID NO: 2734 - protein, 7 aa, synthetic construct
KDSERPS

SEQ ID NO: 2735 - protein, 7 aa, synthetic construct
GKNNRPS

SEQ ID NO: 2736 - protein, 7 aa, synthetic construct
DTSNKHS

SEQ ID NO: 2737 - protein, 7 aa, synthetic construct
EVSKRPS

SEQ ID NO: 2738 - protein, 7 aa, synthetic construct
DVSKRPS

SEQ ID NO: 2739 - protein, 7 aa, synthetic construct
EVSNRPS

SEQ ID NO: 2740 - protein, 7 aa, synthetic construct
DVSKRPS

SEQ ID NO: 2741 - protein, 7 aa, synthetic construct
DVSKRPS

SEQ ID NO: 2742 - protein, 7 aa, synthetic construct
EVSKRPS

SEQ ID NO: 2743 - protein, 7 aa, synthetic construct
QDSKRPS

SEQ ID NO: 2744 - protein, 7 aa, synthetic construct
KDSERPS

SEQ ID NO: 2745 - protein, 7 aa, synthetic construct
QDSKRPS

SEQ ID NO: 2746 - protein, 7 aa, synthetic construct
QDSKRPS

SEQ ID NO: 2747 - protein, 7 aa, synthetic construct
EDSKRPS

SEQ ID NO: 2748 - protein, 7 aa, synthetic construct
EDSKRPS

SEQ ID NO: 2749 - protein, 7 aa, synthetic construct
DVSKRPS

SEQ ID NO: 2750 - protein, 7 aa, synthetic construct
GKNNRPS

SEQ ID NO: 2751 - protein, 7 aa, synthetic construct
GKNNRPS

SEQ ID NO: 2752 - protein, 7 aa, synthetic construct
GKNNRPS

SEQ ID NO: 2753 - protein, 7 aa, synthetic construct
YDSDRPS

SEQ ID NO: 2754 - protein, 7 aa, synthetic construct
GKNNRPS

SEQ ID NO: 2755 - protein, 7 aa, synthetic construct
GKNNRPS

SEQ ID NO: 2756 - protein, 7 aa, synthetic construct
GKNNRPS

SEQ ID NO: 2757 - protein, 7 aa, synthetic construct
GKKNRPS

SEQ ID NO: 2758 - protein, 7 aa, synthetic construct
EDSKRPS

SEQ ID NO: 2759 - protein, 7 aa, synthetic construct
GKNNRPS

SEQ ID NO: 2760 - protein, 7 aa, synthetic construct
GKNNRPS

SEQ ID NO: 2761 - protein, 7 aa, synthetic construct
GKNNRPS

SEQ ID NO: 2762 - protein, 7 aa, synthetic construct
STSNKHS

SEQ ID NO: 2763 - protein, 7 aa, synthetic construct
DVTKRPS

SEQ ID NO: 2764 - protein, 7 aa, synthetic construct
VNNNRPS

SEQ ID NO: 2765 - protein, 7 aa, synthetic construct
DVSKRPS

SEQ ID NO: 2766 - protein, 7 aa, synthetic construct
GNSNRPS

SEQ ID NO: 2767 - protein, 11 aa, synthetic construct
YKSDSDKHQDS

SEQ ID NO: 2768 - protein, 11 aa, synthetic construct
YKSDSDKQQGS

SEQ ID NO: 2769 - protein, 11 aa, synthetic construct
YKSDSDKQQGS

SEQ ID NO: 2770 - protein, 7 aa, synthetic construct
GKNNRPS

SEQ ID NO: 2771 - protein, 7 aa, synthetic construct
GKNNRPS

SEQ ID NO: 2772 - protein, 7 aa, synthetic construct
GKNNRPS

SEQ ID NO: 2773 - protein, 7 aa, synthetic construct
GKNNRPS

SEQ ID NO: 2774 - protein, 7 aa, synthetic construct
HKNNRPS

SEQ ID NO: 2775 - protein, 7 aa, synthetic construct
GKNNRPS

SEQ ID NO: 2776 - protein, 7 aa, synthetic construct
EDSKRPS

SEQ ID NO: 2777 - protein, 7 aa, synthetic construct
EVSKRPS

SEQ ID NO: 2778 - protein, 7 aa, synthetic construct
EVSKRPS

SEQ ID NO: 2779 - protein, 7 aa, synthetic construct
STSNKHS

SEQ ID NO: 2780 - protein, 7 aa, synthetic construct
GNSNRPS

SEQ ID NO: 2781 - protein, 7 aa, synthetic construct
KDSERPS

SEQ ID NO: 2782 - protein, 7 aa, synthetic construct
EDSKRPS

SEQ ID NO: 2783 - protein, 7 aa, synthetic construct
YDSDRPS

SEQ ID NO: 2784 - protein, 7 aa, synthetic construct
AVSKRPS

SEQ ID NO: 2785 - protein, 7 aa, synthetic construct
DVSKRPS

SEQ ID NO: 2786 - protein, 7 aa, synthetic construct
EVNKRPS

SEQ ID NO: 2787 - protein, 7 aa, synthetic construct
DVSKRPS

SEQ ID NO: 2788 - protein, 7 aa, synthetic construct
GNSNRPS

SEQ ID NO: 2789 - protein, 7 aa, synthetic construct
DVSNRPS

SEQ ID NO: 2790 - protein, 7 aa, synthetic construct
DNIIRPS

SEQ ID NO: 2791 - protein, 7 aa, synthetic construct
QDSKRPS

SEQ ID NO: 2792 - protein, 7 aa, synthetic construct
EDSKRPS

SEQ ID NO: 2793 - protein, 7 aa, synthetic construct
GKNNRPS

SEQ ID NO: 2794 - protein, 7 aa, synthetic construct
GKNNRPS

SEQ ID NO: 2795 - protein, 7 aa, synthetic construct
EDSKRPS

SEQ ID NO: 2796 - protein, 7 aa, synthetic construct
GKNNRPS

SEQ ID NO: 2797 - protein, 7 aa, synthetic construct
GKNNRPS

SEQ ID NO: 2798 - protein, 7 aa, synthetic construct
GKNNRPS

SEQ ID NO: 2799 - protein, 7 aa, synthetic construct
EVSNRPS

SEQ ID NO: 2800 - protein, 7 aa, synthetic construct
DVSKRPS

SEQ ID NO: 2801 - protein, 7 aa, synthetic construct
GRNNRPS

SEQ ID NO: 2802 - protein, 7 aa, synthetic construct
YDSDRPS

SEQ ID NO: 2803 - protein, 7 aa, synthetic construct
GKNNRPS

SEQ ID NO: 2804 - protein, 7 aa, synthetic construct
GKNKRPS

SEQ ID NO: 2805 - protein, 7 aa, synthetic construct
DVSKRPS

SEQ ID NO: 2806 - protein, 7 aa, synthetic construct
GNSNRPS

SEQ ID NO: 2807 - protein, 7 aa, synthetic construct
GKNNRPS

SEQ ID NO: 2808 - protein, 7 aa, synthetic construct
DVSKRPS

SEQ ID NO: 2809 - protein, 7 aa, synthetic construct
QDSKRPS

SEQ ID NO: 2810 - protein, 7 aa, synthetic construct
EDNKRPS

SEQ ID NO: 2811 - protein, 7 aa, synthetic construct
GKNNRPS

SEQ ID NO: 2812 - protein, 7 aa, synthetic construct
EVSKRPS

SEQ ID NO: 2813 - protein, 7 aa, synthetic construct
GKNKRPS

SEQ ID NO: 2814 - protein, 7 aa, synthetic construct
DDSDRPS

SEQ ID NO: 2815 - protein, 7 aa, synthetic construct
QDIKRPS

SEQ ID NO: 2816 - protein, 7 aa, synthetic construct
GKNNRPS

SEQ ID NO: 2817 - protein, 7 aa, synthetic construct
EVSKRPS

SEQ ID NO: 2818 - protein, 7 aa, synthetic construct
EVSNRPS

SEQ ID NO: 2819 - protein, 7 aa, synthetic construct
DTSNKHS

SEQ ID NO: 2820 - protein, 9 aa, synthetic construct
GGSISSSSY

SEQ ID NO: 2821 - protein, 7 aa, synthetic construct
GFTFSNA

SEQ ID NO: 2822 - protein, 7 aa, synthetic construct
GFTFDDY

SEQ ID NO: 2823 - protein, 7 aa, synthetic construct
GFTFSSY

SEQ ID NO: 2824 - protein, 7 aa, synthetic construct
GFTFSSS

SEQ ID NO: 2825 - protein, 7 aa, synthetic construct
GFTFSSY

SEQ ID NO: 2826 - protein, 7 aa, synthetic construct
GYTFTSY

SEQ ID NO: 2827 - protein, 7 aa, synthetic construct
GFTFSSY

SEQ ID NO: 2828 - protein, 7 aa, synthetic construct
GGSFSGY

SEQ ID NO: 2829 - protein, 7 aa, synthetic construct
GFTFSSY

SEQ ID NO: 2830 - protein, 7 aa, synthetic construct
GYTFTSY

SEQ ID NO: 2831 - protein, 7 aa, synthetic construct
GGSFSGY

SEQ ID NO: 2832 - protein, 7 aa, synthetic construct
GFTVSSN

SEQ ID NO: 2833 - protein, 7 aa, synthetic construct
GFTFSTY

SEQ ID NO: 2834 - protein, 7 aa, synthetic construct
GFTFSSY

SEQ ID NO: 2835 - protein, 7 aa, synthetic construct
GYTFTTY

SEQ ID NO: 2836 - protein, 7 aa, synthetic construct
GFTFSVS

SEQ ID NO: 2837 - protein, 7 aa, synthetic construct
GFTFSNA

SEQ ID NO: 2838 - protein, 7 aa, synthetic construct
GFTFDDY

SEQ ID NO: 2839 - protein, 7 aa, synthetic construct
GFTFSDA

SEQ ID NO: 2840 - protein, 7 aa, synthetic construct
GFTFDDY

SEQ ID NO: 2841 - protein, 7 aa, synthetic construct
GFTVSSN

SEQ ID NO: 2842 - protein, 7 aa, synthetic construct
GYTFTSF

SEQ ID NO: 2843 - protein, 7 aa, synthetic construct
GFTFSGS

SEQ ID NO: 2844 - protein, 7 aa, synthetic construct
GFTVSSN

SEQ ID NO: 2845 - protein, 7 aa, synthetic construct
GFTFSSY

SEQ ID NO: 2846 - protein, 7 aa, synthetic construct
GFTFSSY

SEQ ID NO: 2847 - protein, 7 aa, synthetic construct
GFTFSSY

SEQ ID NO: 2848 - protein, 7 aa, synthetic construct
GFTFSSY

SEQ ID NO: 2849 - protein, 7 aa, synthetic construct
GFTFSSY

SEQ ID NO: 2850 - protein, 7 aa, synthetic construct
GFTFSSY

SEQ ID NO: 2851 - protein, 7 aa, synthetic construct
GFTFSSY

SEQ ID NO: 2852 - protein, 7 aa, synthetic construct
GFTFSSY

SEQ ID NO: 2853 - protein, 7 aa, synthetic construct
GFPFSNS

SEQ ID NO: 2854 - protein, 7 aa, synthetic construct
GYTFTGY

SEQ ID NO: 2855 - protein, 7 aa, synthetic construct
GFTFSNA

SEQ ID NO: 2856 - protein, 7 aa, synthetic construct
GYTFTSY

SEQ ID NO: 2857 - protein, 7 aa, synthetic construct
GFTFSSY

SEQ ID NO: 2858 - protein, 7 aa, synthetic construct
GYSFTSY

SEQ ID NO: 2859 - protein, 7 aa, synthetic construct
GFTFSSY

SEQ ID NO: 2860 - protein, 7 aa, synthetic construct
GYTFTGY

SEQ ID NO: 2861 - protein, 7 aa, synthetic construct
GFTFSSY

SEQ ID NO: 2862 - protein, 7 aa, synthetic construct
GFTFSNA

SEQ ID NO: 2863 - protein, 7 aa, synthetic construct
GFTFSSY

SEQ ID NO: 2864 - protein, 7 aa, synthetic construct
GFTFSSY

SEQ ID NO: 2865 - protein, 7 aa, synthetic construct
GFTFSSY

SEQ ID NO: 2866 - protein, 7 aa, synthetic construct
GFTFSSY

SEQ ID NO: 2867 - protein, 7 aa, synthetic construct
GFTFDDY

SEQ ID NO: 2868 - protein, 7 aa, synthetic construct
GYSFTSY

SEQ ID NO: 2869 - protein, 7 aa, synthetic construct
GYTFTGY

SEQ ID NO: 2870 - protein, 7 aa, synthetic construct
GFTFDDH

SEQ ID NO: 2871 - protein, 7 aa, synthetic construct
GFTFDDY

SEQ ID NO: 2872 - protein, 7 aa, synthetic construct
GFTFSSY

SEQ ID NO: 2873 - protein, 7 aa, synthetic construct
GFTFSSY

SEQ ID NO: 2874 - protein, 7 aa, synthetic construct
GYTFTSY

SEQ ID NO: 2875 - protein, 7 aa, synthetic construct
GFTFSSY

SEQ ID NO: 2876 - protein, 7 aa, synthetic construct
GFTFSGS

SEQ ID NO: 2877 - protein, 7 aa, synthetic construct
GFTFSSY

SEQ ID NO: 2878 - protein, 7 aa, synthetic construct
GYTLTEL

SEQ ID NO: 2879 - protein, 7 aa, synthetic construct
GYTLTEL

SEQ ID NO: 2880 - protein, 7 aa, synthetic construct
GFTFSSY

SEQ ID NO: 2881 - protein, 7 aa, synthetic construct
GFTFSNA

SEQ ID NO: 2882 - protein, 7 aa, synthetic construct
GFTFSSY

SEQ ID NO: 2883 - protein, 7 aa, synthetic construct
GFTFSSY

SEQ ID NO: 2884 - protein, 8 aa, synthetic construct
GGSISSSD

SEQ ID NO: 2885 - protein, 7 aa, synthetic construct
GGSFSGY

SEQ ID NO: 2886 - protein, 7 aa, synthetic construct
GFTFSSY

SEQ ID NO: 2887 - protein, 9 aa, synthetic construct
GFSLSTSGV

SEQ ID NO: 2888 - protein, 7 aa, synthetic construct
GYTFTSY

SEQ ID NO: 2889 - protein, 7 aa, synthetic construct
GFTFSRY

SEQ ID NO: 2890 - protein, 7 aa, synthetic construct
GFTFSSS

SEQ ID NO: 2891 - protein, 7 aa, synthetic construct
GFTFSSY

SEQ ID NO: 2892 - protein, 7 aa, synthetic construct
GFTFSSY

SEQ ID NO: 2893 - protein, 7 aa, synthetic construct
GFTFSSY

SEQ ID NO: 2894 - protein, 7 aa, synthetic construct
GFTFSDY

SEQ ID NO: 2895 - protein, 7 aa, synthetic construct
GFTFSEY

SEQ ID NO: 2896 - protein, 7 aa, synthetic construct
GFTFSSY

SEQ ID NO: 2897 - protein, 7 aa, synthetic construct
GFTFDDY

SEQ ID NO: 2898 - protein, 7 aa, synthetic construct
GFTFSDY

SEQ ID NO: 2899 - protein, 7 aa, synthetic construct
GFTFSSY

SEQ ID NO: 2900 - protein, 7 aa, synthetic construct
GFTFSSY

SEQ ID NO: 2901 - protein, 7 aa, synthetic construct
GFTFSSY

SEQ ID NO: 2902 - protein, 7 aa, synthetic construct
GYTLTEL

SEQ ID NO: 2903 - protein, 7 aa, synthetic construct
GFTFSSY

SEQ ID NO: 2904 - protein, 7 aa, synthetic construct
GFTFSNY

SEQ ID NO: 2905 - protein, 7 aa, synthetic construct
GFTFSNA

SEQ ID NO: 2906 - protein, 7 aa, synthetic construct
GYSFTSY

SEQ ID NO: 2907 - protein, 7 aa, synthetic construct
GFTFSSY

SEQ ID NO: 2908 - protein, 9 aa, synthetic construct
GFSLSTSGV

SEQ ID NO: 2909 - protein, 7 aa, synthetic construct
GYTFSSY

SEQ ID NO: 2910 - protein, 7 aa, synthetic construct
YMHWVRQ

SEQ ID NO: 2911 - protein, 7 aa, synthetic construct
GYTFTDH

SEQ ID NO: 2912 - protein, 7 aa, synthetic construct
GFTFDDY

SEQ ID NO: 2913 - protein, 8 aa, synthetic construct
GGSITSSN

SEQ ID NO: 2914 - protein, 7 aa, synthetic construct
GFTFSSY

SEQ ID NO: 2915 - protein, 7 aa, synthetic construct
GYTFTSY

SEQ ID NO: 2916 - protein, 7 aa, synthetic construct
GFTFSSY

SEQ ID NO: 2917 - protein, 7 aa, synthetic construct
GYTLTEL

SEQ ID NO: 2918 - protein, 7 aa, synthetic construct
GYTVTRH

SEQ ID NO: 2919 - protein, 7 aa, synthetic construct
GYAFRGQ

SEQ ID NO: 2920 - protein, 7 aa, synthetic construct
GFTFSDS

SEQ ID NO: 2921 - protein, 9 aa, synthetic construct
GFSLSTSGV

SEQ ID NO: 2922 - protein, 7 aa, synthetic construct
GYTFTSY

SEQ ID NO: 2923 - protein, 7 aa, synthetic construct
GFTFDDY

SEQ ID NO: 2924 - protein, 7 aa, synthetic construct
GFTFDDY

SEQ ID NO: 2925 - protein, 7 aa, synthetic construct
GFTFSNA

SEQ ID NO: 2926 - protein, 9 aa, synthetic construct
GDSVSSNSA

SEQ ID NO: 2927 - protein, 7 aa, synthetic construct
GYTFTRN

SEQ ID NO: 2928 - protein, 7 aa, synthetic construct
GYTFTTY

SEQ ID NO: 2929 - protein, 7 aa, synthetic construct
GFTFSSY

SEQ ID NO: 2930 - protein, 7 aa, synthetic construct
GYTFTSY

SEQ ID NO: 2931 - protein, 7 aa, synthetic construct
GFTFSNA

SEQ ID NO: 2932 - protein, 9 aa, synthetic construct
GDSVSSNSA

SEQ ID NO: 2933 - protein, 7 aa, synthetic construct
GFTFSTY

SEQ ID NO: 2934 - protein, 7 aa, synthetic construct
GYSFTGY

SEQ ID NO: 2935 - protein, 9 aa, synthetic construct
GGSISSSSY

SEQ ID NO: 2936 - protein, 9 aa, synthetic construct
GDSVSSNSA

SEQ ID NO: 2937 - protein, 9 aa, synthetic construct
GDSVSSNSA

SEQ ID NO: 2938 - protein, 7 aa, synthetic construct
GGSFSGH

SEQ ID NO: 2939 - protein, 9 aa, synthetic construct
GDSVSSNSA

SEQ ID NO: 2940 - protein, 7 aa, synthetic construct
GFIFSSY

SEQ ID NO: 2941 - protein, 7 aa, synthetic construct
GFDFTNA

SEQ ID NO: 2942 - protein, 7 aa, synthetic construct
RFTFSSA

SEQ ID NO: 2943 - protein, 9 aa, synthetic construct
GGSISSSSY

SEQ ID NO: 2944 - protein, 9 aa, synthetic construct
GGSISSSSY

SEQ ID NO: 2945 - protein, 7 aa, synthetic construct
GGSFSGY

SEQ ID NO: 2946 - protein, 9 aa, synthetic construct
GGSISSSSY

SEQ ID NO: 2947 - protein, 7 aa, synthetic construct
GGSFSGY

SEQ ID NO: 2948 - protein, 7 aa, synthetic construct
GYTFTSY

SEQ ID NO: 2949 - protein, 5 aa, synthetic construct
YYSGS

SEQ ID NO: 2950 - protein, 8 aa, synthetic construct
KSKTDGGT

SEQ ID NO: 2951 - protein, 6 aa, synthetic construct
NWNGGS

SEQ ID NO: 2952 - protein, 6 aa, synthetic construct
SSSSST

SEQ ID NO: 2953 - protein, 5 aa, synthetic construct
YTTGD

SEQ ID NO: 2954 - protein, 6 aa, synthetic construct
SGSGGS

SEQ ID NO: 2955 - protein, 6 aa, synthetic construct
SAYNGN

SEQ ID NO: 2956 - protein, 6 aa, synthetic construct
SGSGGS

SEQ ID NO: 2957 - protein, 5 aa, synthetic construct
NHSGS

SEQ ID NO: 2958 - protein, 6 aa, synthetic construct
WYDGSN

SEQ ID NO: 2959 - protein, 6 aa, synthetic construct
SAYNGN

SEQ ID NO: 2960 - protein, 5 aa, synthetic construct
NHSGS

SEQ ID NO: 2961 - protein, 5 aa, synthetic construct
YSGGS

SEQ ID NO: 2962 - protein, 6 aa, synthetic construct
SGSSSY

SEQ ID NO: 2963 - protein, 5 aa, synthetic construct
GTAGD

SEQ ID NO: 2964 - protein, 6 aa, synthetic construct
SAYNGN

SEQ ID NO: 2965 - protein, 8 aa, synthetic construct
RSKANSYA

SEQ ID NO: 2966 - protein, 8 aa, synthetic construct
KSKTDGGT

SEQ ID NO: 2967 - protein, 6 aa, synthetic construct
SWNSGS

SEQ ID NO: 2968 - protein, 8 aa, synthetic construct
KSKTDGGT

SEQ ID NO: 2969 - protein, 6 aa, synthetic construct
NWNGGS

SEQ ID NO: 2970 - protein, 5 aa, synthetic construct
YSGGS

SEQ ID NO: 2971 - protein, 6 aa, synthetic construct
SAYNDN

SEQ ID NO: 2972 - protein, 8 aa, synthetic construct
RSKANSYA

SEQ ID NO: 2973 - protein, 5 aa, synthetic construct
YSGGS

SEQ ID NO: 2974 - protein, 6 aa, synthetic construct
SSSSSY

SEQ ID NO: 2975 - protein, 5 aa, synthetic construct
GTAGD

SEQ ID NO: 2976 - protein, 6 aa, synthetic construct
SSSSSY

SEQ ID NO: 2977 - protein, 6 aa, synthetic construct
KQDGSE

SEQ ID NO: 2978 - protein, 6 aa, synthetic construct
SGSGGS

SEQ ID NO: 2979 - protein, 6 aa, synthetic construct
SGSGGS

SEQ ID NO: 2980 - protein, 6 aa, synthetic construct
SGSGGS

SEQ ID NO: 2981 - protein, 6 aa, synthetic construct
WYDGSN

SEQ ID NO: 2982 - protein, 6 aa, synthetic construct
SYDGNS

SEQ ID NO: 2983 - protein, 6 aa, synthetic construct
NPNSGG

SEQ ID NO: 2984 - protein, 8 aa, synthetic construct
KSKTDGGT

SEQ ID NO: 2985 - protein, 6 aa, synthetic construct
NPNSGN

SEQ ID NO: 2986 - protein, 6 aa, synthetic construct
SYDGSN

SEQ ID NO: 2987 - protein, 6 aa, synthetic construct
YPGDSD

SEQ ID NO: 2988 - protein, 6 aa, synthetic construct
SSSSSY

SEQ ID NO: 2989 - protein, 6 aa, synthetic construct
NPNSGG

SEQ ID NO: 2990 - protein, 5 aa, synthetic construct
GTAGD

SEQ ID NO: 2991 - protein, 8 aa, synthetic construct
KSKTDGGT

SEQ ID NO: 2992 - protein, 6 aa, synthetic construct
SGSGGS

SEQ ID NO: 2993 - protein, 6 aa, synthetic construct
SGSGGS

SEQ ID NO: 2994 - protein, 6 aa, synthetic construct
SGSGGS

SEQ ID NO: 2995 - protein, 6 aa, synthetic construct
WYDGSN

SEQ ID NO: 2996 - protein, 6 aa, synthetic construct
NWNGGS

SEQ ID NO: 2997 - protein, 6 aa, synthetic construct
YPGDSD

SEQ ID NO: 2998 - protein, 6 aa, synthetic construct
NPNSGG

SEQ ID NO: 2999 - protein, 6 aa, synthetic construct
TWNSNI

SEQ ID NO: 3000 - protein, 6 aa, synthetic construct
SWNSGS

SEQ ID NO: 3001 - protein, 6 aa, synthetic construct
NSDGGN

SEQ ID NO: 3002 - protein, 6 aa, synthetic construct
KQDGSE

SEQ ID NO: 3003 - protein, 6 aa, synthetic construct
NPNSGN

SEQ ID NO: 3004 - protein, 6 aa, synthetic construct
WYDGSN

SEQ ID NO: 3005 - protein, 8 aa, synthetic construct
RSKANSYA

SEQ ID NO: 3006 - protein, 6 aa, synthetic construct
SSSSSY

SEQ ID NO: 3007 - protein, 6 aa, synthetic construct
DPEDGE

SEQ ID NO: 3008 - protein, 6 aa, synthetic construct
DPEDGE

SEQ ID NO: 3009 - protein, 6 aa, synthetic construct
SSSSST

SEQ ID NO: 3010 - protein, 8 aa, synthetic construct
KSKTDGGT

SEQ ID NO: 3011 - protein, 6 aa, synthetic construct
SSSSSY

SEQ ID NO: 3012 - protein, 6 aa, synthetic construct
SGSGGS

SEQ ID NO: 3013 - protein, 5 aa, synthetic construct
NHSGT

SEQ ID NO: 3014 - protein, 5 aa, synthetic construct
NHSGS

SEQ ID NO: 3015 - protein, 6 aa, synthetic construct
KQDGSE

SEQ ID NO: 3016 - protein, 5 aa, synthetic construct
YWNDD

SEQ ID NO: 3017 - protein, 6 aa, synthetic construct
SAYNGN

SEQ ID NO: 3018 - protein, 5 aa, synthetic construct
NTAGD

SEQ ID NO: 3019 - protein, 5 aa, synthetic construct
YTTGD

SEQ ID NO: 3020 - protein, 6 aa, synthetic construct
SSSSST

SEQ ID NO: 3021 - protein, 6 aa, synthetic construct
SGSGGS

SEQ ID NO: 3022 - protein, 6 aa, synthetic construct
SYDGSN

SEQ ID NO: 3023 - protein, 6 aa, synthetic construct
SSSGST

SEQ ID NO: 3024 - protein, 6 aa, synthetic construct
NSDGSR

SEQ ID NO: 3025 - protein, 6 aa, synthetic construct
NSDGSG

SEQ ID NO: 3026 - protein, 6 aa, synthetic construct
SWNSGS

SEQ ID NO: 3027 - protein, 6 aa, synthetic construct
SHSGTT

SEQ ID NO: 3028 - protein, 6 aa, synthetic construct
NDSGYS

SEQ ID NO: 3029 - protein, 5 aa, synthetic construct
GTAGD

SEQ ID NO: 3030 - protein, 6 aa, synthetic construct
SSSSST

SEQ ID NO: 3031 - protein, 6 aa, synthetic construct
DPEDGE

SEQ ID NO: 3032 - protein, 6 aa, synthetic construct
SSSSSY

SEQ ID NO: 3033 - protein, 6 aa, synthetic construct
WSDGSN

SEQ ID NO: 3034 - protein, 8 aa, synthetic construct
KSKTDGGT

SEQ ID NO: 3035 - protein, 6 aa, synthetic construct
YPGDSD

SEQ ID NO: 3036 - protein, 6 aa, synthetic construct
KQDGSE

SEQ ID NO: 3037 - protein, 5 aa, synthetic construct
YWNDD

SEQ ID NO: 3038 - protein, 6 aa, synthetic construct
SAYNGN

SEQ ID NO: 3039 - protein, 6 aa, synthetic construct
NYAQKF

SEQ ID NO: 3040 - protein, 6 aa, synthetic construct
NPNSGG

SEQ ID NO: 3041 - protein, 6 aa, synthetic construct
SWNSGS

SEQ ID NO: 3042 - protein, 5 aa, synthetic construct
YHSGN

SEQ ID NO: 3043 - protein, 6 aa, synthetic construct
SSSSSY

SEQ ID NO: 3044 - protein, 6 aa, synthetic construct
NTNTGN

SEQ ID NO: 3045 - protein, 6 aa, synthetic construct
SSSSSY

SEQ ID NO: 3046 - protein, 6 aa, synthetic construct
DPEDGE

SEQ ID NO: 3047 - protein, 6 aa, synthetic construct
NTNTGT

SEQ ID NO: 3048 - protein, 6 aa, synthetic construct
RPNSGD

SEQ ID NO: 3049 - protein, 8 aa, synthetic construct
RGKPNTYA

SEQ ID NO: 3050 - protein, 5 aa, synthetic construct
YWNDD

SEQ ID NO: 3051 - protein, 6 aa, synthetic construct
SAYNGN

SEQ ID NO: 3052 - protein, 6 aa, synthetic construct
SWNSGS

SEQ ID NO: 3053 - protein, 6 aa, synthetic construct
SRNSGS

SEQ ID NO: 3054 - protein, 8 aa, synthetic construct
KSKTDGGT

SEQ ID NO: 3055 - protein, 7 aa, synthetic construct
YYRSKWY

SEQ ID NO: 3056 - protein, 6 aa, synthetic construct
DTHTGN

SEQ ID NO: 3057 - protein, 6 aa, synthetic construct
SAYNGN

SEQ ID NO: 3058 - protein, 6 aa, synthetic construct
KQDGSE

SEQ ID NO: 3059 - protein, 6 aa, synthetic construct
SAYNGN

SEQ ID NO: 3060 - protein, 8 aa, synthetic construct
KSKTDGGT

SEQ ID NO: 3061 - protein, 7 aa, synthetic construct
YYRSKWY

SEQ ID NO: 3062 - protein, 6 aa, synthetic construct
SSRSSY

SEQ ID NO: 3063 - protein, 6 aa, synthetic construct
NPNSGG

SEQ ID NO: 3064 - protein, 5 aa, synthetic construct
YYSGS

SEQ ID NO: 3065 - protein, 7 aa, synthetic construct
YYRSKWY

SEQ ID NO: 3066 - protein, 7 aa, synthetic construct
YYRSKWY

SEQ ID NO: 3067 - protein, 5 aa, synthetic construct
NHSGF

SEQ ID NO: 3068 - protein, 7 aa, synthetic construct
YYRSKWY

SEQ ID NO: 3069 - protein, 6 aa, synthetic construct
SGSSSF

SEQ ID NO: 3070 - protein, 8 aa, synthetic construct
KSKTDGGS

SEQ ID NO: 3071 - protein, 8 aa, synthetic construct
KTKTEGGT

SEQ ID NO: 3072 - protein, 5 aa, synthetic construct
YYSGS

SEQ ID NO: 3073 - protein, 5 aa, synthetic construct
YYSGS

SEQ ID NO: 3074 - protein, 5 aa, synthetic construct
NHSGS

SEQ ID NO: 3075 - protein, 5 aa, synthetic construct
YYSGS

SEQ ID NO: 3076 - protein, 5 aa, synthetic construct
NHSGS

SEQ ID NO: 3077 - protein, 6 aa, synthetic construct
NPKNGY

SEQ ID NO: 3078 - protein, 14 aa, synthetic construct
TGTSSDVGGYNYVS

SEQ ID NO: 3079 - protein, 11 aa, synthetic construct
SGDALPKKYAY

SEQ ID NO: 3080 - protein, 14 aa, synthetic construct
TGSSSNIGAGYDVH

SEQ ID NO: 3081 - protein, 11 aa, synthetic construct
SGDVLAKKYAR

SEQ ID NO: 3082 - protein, 11 aa, synthetic construct
SGDALPKKYAY

SEQ ID NO: 3083 - protein, 14 aa, synthetic construct
TGSSSNIGAGYDVH

SEQ ID NO: 3084 - protein, 14 aa, synthetic construct
TGTSSDVGGYNYVS

SEQ ID NO: 3085 - protein, 14 aa, synthetic construct
TGTSSDVGGYNYVS

SEQ ID NO: 3086 - protein, 11 aa, synthetic construct
QGDSLRSYYAS

SEQ ID NO: 3087 - protein, 11 aa, synthetic construct
GGNNIGSKSVH

SEQ ID NO: 3088 - protein, 13 aa, synthetic construct
SGSSSNIGSNTVN

SEQ ID NO: 3089 - protein, 14 aa, synthetic construct
TGTSSDVGGYNYVS

SEQ ID NO: 3090 - protein, 13 aa, synthetic construct
SGSSSNIGNNAVN

SEQ ID NO: 3091 - protein, 11 aa, synthetic construct
GGNNIGSKNVH

SEQ ID NO: 3092 - protein, 11 aa, synthetic construct
SGDALPKKYAY

SEQ ID NO: 3093 - protein, 14 aa, synthetic construct
TGTSSDVGGYNYVS

SEQ ID NO: 3094 - protein, 11 aa, synthetic construct
SGDKLGDKYAC

SEQ ID NO: 3095 - protein, 11 aa, synthetic construct
SADALPNQYAY

SEQ ID NO: 3096 - protein, 11 aa, synthetic construct
SGDALPKKYAY

SEQ ID NO: 3097 - protein, 11 aa, synthetic construct
SGDALPKKYAY

SEQ ID NO: 3098 - protein, 11 aa, synthetic construct
SGDALPKKYAY

SEQ ID NO: 3099 - protein, 11 aa, synthetic construct
SGDALPKKYAY

SEQ ID NO: 3100 - protein, 14 aa, synthetic construct
TGTSSDVGGYNYVS

SEQ ID NO: 3101 - protein, 14 aa, synthetic construct
TGTSSDVGGYNYVS

SEQ ID NO: 3102 - protein, 14 aa, synthetic construct
TGTSSDVGGYNYVS

SEQ ID NO: 3103 - protein, 11 aa, synthetic construct
SGDVLAKKYAR

SEQ ID NO: 3104 - protein, 11 aa, synthetic construct
SADALPKQYAY

SEQ ID NO: 3105 - protein, 11 aa, synthetic construct
SGDALPKKYAY

SEQ ID NO: 3106 - protein, 11 aa, synthetic construct
SGDALPKKYAY

SEQ ID NO: 3107 - protein, 11 aa, synthetic construct
SGDALPKKYAY

SEQ ID NO: 3108 - protein, 11 aa, synthetic construct
SGDALPKKYAY

SEQ ID NO: 3109 - protein, 11 aa, synthetic construct
SGDALPKKYAY

SEQ ID NO: 3110 - protein, 11 aa, synthetic construct
GGNNIGSKNVH

SEQ ID NO: 3111 - protein, 11 aa, synthetic construct
QGDSLRSYYAS

SEQ ID NO: 3112 - protein, 14 aa, synthetic construct
ASSTGAVTSGYYPN

SEQ ID NO: 3113 - protein, 13 aa, synthetic construct
SGSSSNIGSNTVN

SEQ ID NO: 3114 - protein, 11 aa, synthetic construct
SGDKLGDKYAC

SEQ ID NO: 3115 - protein, 11 aa, synthetic construct
SGDKLGDKYAC

SEQ ID NO: 3116 - protein, 11 aa, synthetic construct
SGDKLGDKYAC

SEQ ID NO: 3117 - protein, 11 aa, synthetic construct
SGDALPKKYAY

SEQ ID NO: 3118 - protein, 11 aa, synthetic construct
SGDALPKKYAY

SEQ ID NO: 3119 - protein, 11 aa, synthetic construct
SGDALPKKYAY

SEQ ID NO: 3120 - protein, 11 aa, synthetic construct
SGDALPKKYAY

SEQ ID NO: 3121 - protein, 11 aa, synthetic construct
SGDALPKKYAY

SEQ ID NO: 3122 - protein, 11 aa, synthetic construct
SGDALPKKYAY

SEQ ID NO: 3123 - protein, 11 aa, synthetic construct
SGDALPKKYAY

SEQ ID NO: 3124 - protein, 11 aa, synthetic construct
QGDSLRSYYAS

SEQ ID NO: 3125 - protein, 11 aa, synthetic construct
QGDSLRSYYAS

SEQ ID NO: 3126 - protein, 11 aa, synthetic construct
SGDALPKKYAY

SEQ ID NO: 3127 - protein, 14 aa, synthetic construct
TGTSSDVGGYNYVS

SEQ ID NO: 3128 - protein, 14 aa, synthetic construct
TGTSSDVGGYNYVS

SEQ ID NO: 3129 - protein, 14 aa, synthetic construct
TGTSSDVGGYNYVS

SEQ ID NO: 3130 - protein, 14 aa, synthetic construct
TLRSGIYVGTYRIY

SEQ ID NO: 3131 - protein, 11 aa, synthetic construct
SGDKLGDKYAC

SEQ ID NO: 3132 - protein, 11 aa, synthetic construct
SGDKLGDKYAC

SEQ ID NO: 3133 - protein, 11 aa, synthetic construct
SGDVLAKKYAR

SEQ ID NO: 3134 - protein, 11 aa, synthetic construct
SGDVLAKKYAR

SEQ ID NO: 3135 - protein, 11 aa, synthetic construct
SGDALPKKYAY

SEQ ID NO: 3136 - protein, 11 aa, synthetic construct
SGDALPKKYAY

SEQ ID NO: 3137 - protein, 11 aa, synthetic construct
QGDSLRSYYAS

SEQ ID NO: 3138 - protein, 11 aa, synthetic construct
SGDALPKKYAY

SEQ ID NO: 3139 - protein, 11 aa, synthetic construct
SGDALPKKYAY

SEQ ID NO: 3140 - protein, 14 aa, synthetic construct
ASSTGAVTSGYYPN

SEQ ID NO: 3141 - protein, 14 aa, synthetic construct
TGTSSDVGGYNYVS

SEQ ID NO: 3142 - protein, 14 aa, synthetic construct
TGSSSNIGAGYDVH

SEQ ID NO: 3143 - protein, 11 aa, synthetic construct
QGDSLRNYYAS

SEQ ID NO: 3144 - protein, 11 aa, synthetic construct
QGDSLRSYYAS

SEQ ID NO: 3145 - protein, 11 aa, synthetic construct
QGDSLRSYYAS

SEQ ID NO: 3146 - protein, 11 aa, synthetic construct
SGDALPKKYAY

SEQ ID NO: 3147 - protein, 11 aa, synthetic construct
QGDNLRNYSVS

SEQ ID NO: 3148 - protein, 11 aa, synthetic construct
SGDALPKKYAY

SEQ ID NO: 3149 - protein, 11 aa, synthetic construct
SGDALPKKYAY

SEQ ID NO: 3150 - protein, 11 aa, synthetic construct
SGDALPKKYAY

SEQ ID NO: 3151 - protein, 11 aa, synthetic construct
QGDSLRSYYAS

SEQ ID NO: 3152 - protein, 11 aa, synthetic construct
GGNNIGSKSVH

SEQ ID NO: 3153 - protein, 11 aa, synthetic construct
QGDSLRSYYAN

SEQ ID NO: 3154 - protein, 11 aa, synthetic construct
QGDSLRTYYAS

SEQ ID NO: 3155 - protein, 11 aa, synthetic construct
SGDALPKKYAY

SEQ ID NO: 3156 - protein, 14 aa, synthetic construct
ASSTGAVTSGYYPN

SEQ ID NO: 3157 - protein, 14 aa, synthetic construct
TGTSSDVGGYNYVS

SEQ ID NO: 3158 - protein, 14 aa, synthetic construct
TGTSSDVGGYNYVS

SEQ ID NO: 3159 - protein, 14 aa, synthetic construct
TGTSSDVGGYNYVS

SEQ ID NO: 3160 - protein, 11 aa, synthetic construct
SGDKLGDKYAC

SEQ ID NO: 3161 - protein, 11 aa, synthetic construct
SGDALPKKYAY

SEQ ID NO: 3162 - protein, 11 aa, synthetic construct
GGNNIGSKSVH

SEQ ID NO: 3163 - protein, 11 aa, synthetic construct
SGDALPKKYAY

SEQ ID NO: 3164 - protein, 11 aa, synthetic construct
SGDALPKKYAY

SEQ ID NO: 3165 - protein, 14 aa, synthetic construct
ASSTGAVTSGYYPN

SEQ ID NO: 3166 - protein, 14 aa, synthetic construct
TGTSSDVGGYNYVS

SEQ ID NO: 3167 - protein, 13 aa, synthetic construct
SGSSSNIGNNAVN

SEQ ID NO: 3168 - protein, 13 aa, synthetic construct
SGSSSNIGSNTVN

SEQ ID NO: 3169 - protein, 13 aa, synthetic construct
SGSISNIGNNAVS

SEQ ID NO: 3170 - protein, 14 aa, synthetic construct
TGTSSDVGGYNYVS

SEQ ID NO: 3171 - protein, 14 aa, synthetic construct
SGSSSNIGAGYDVH

SEQ ID NO: 3172 - protein, 11 aa, synthetic construct
SGDVLAKKYAR

SEQ ID NO: 3173 - protein, 11 aa, synthetic construct
SGDKLGDKYAC

SEQ ID NO: 3174 - protein, 11 aa, synthetic construct
QGDSLRSYYAS

SEQ ID NO: 3175 - protein, 11 aa, synthetic construct
GGNNIGSKSVH

SEQ ID NO: 3176 - protein, 11 aa, synthetic construct
QGDSLRSYYAS

SEQ ID NO: 3177 - protein, 11 aa, synthetic construct
QGDSLRSYYAS

SEQ ID NO: 3178 - protein, 14 aa, synthetic construct
TGTSSDVGAYNYVS

SEQ ID NO: 3179 - protein, 11 aa, synthetic construct
SGDKLGDKYAC

SEQ ID NO: 3180 - protein, 11 aa, synthetic construct
SGDKLGDKYAC

SEQ ID NO: 3181 - protein, 11 aa, synthetic construct
SGDKLGDKYAC

SEQ ID NO: 3182 - protein, 11 aa, synthetic construct
GENNIVNKNVH

SEQ ID NO: 3183 - protein, 11 aa, synthetic construct
SGDALPKKYAY

SEQ ID NO: 3184 - protein, 11 aa, synthetic construct
SGDALPKKYAY

SEQ ID NO: 3185 - protein, 13 aa, synthetic construct
SGSSSNIERTAVN

SEQ ID NO: 3186 - protein, 14 aa, synthetic construct
TGNSSNIGADYDVQ

SEQ ID NO: 3187 - protein, 11 aa, synthetic construct
SGDALPKKYAY

SEQ ID NO: 3188 - protein, 11 aa, synthetic construct
SGDALPKKYAY

SEQ ID NO: 3189 - protein, 11 aa, synthetic construct
QGDSLRSYYAS

SEQ ID NO: 3190 - protein, 11 aa, synthetic construct
SGDALPKKYAY

SEQ ID NO: 3191 - protein, 11 aa, synthetic construct
SGDALPKKYAY

SEQ ID NO: 3192 - protein, 11 aa, synthetic construct
QGDSLRSYYAS

SEQ ID NO: 3193 - protein, 11 aa, synthetic construct
SGDALPKKYAY

SEQ ID NO: 3194 - protein, 11 aa, synthetic construct
GGNNIGSKSVH

SEQ ID NO: 3195 - protein, 11 aa, synthetic construct
SGDALPKKYAY

SEQ ID NO: 3196 - protein, 14 aa, synthetic construct
TGTSSDVGVYNYVS

SEQ ID NO: 3197 - protein, 14 aa, synthetic construct
TGTSSDVGGYNYVS

SEQ ID NO: 3198 - protein, 11 aa, synthetic construct
QGDSLRSYYAS

SEQ ID NO: 3199 - protein, 14 aa, synthetic construct
TGSSSNIGAGYAVH

SEQ ID NO: 3200 - protein, 14 aa, synthetic construct
SCSGSSSNIGAGYA

SEQ ID NO: 3201 - protein, 14 aa, synthetic construct
TLRSGINVGTYRIY

SEQ ID NO: 3202 - protein, 11 aa, synthetic construct
SGDKLGDKYAC

SEQ ID NO: 3203 - protein, 11 aa, synthetic construct
GGNNIGSKSVH

SEQ ID NO: 3204 - protein, 11 aa, synthetic construct
SGDALPKKYAY

SEQ ID NO: 3205 - protein, 11 aa, synthetic construct
SGDKLGDKYAC

SEQ ID NO: 3206 - protein, 14 aa, synthetic construct
TGSSSNIGAGYDVH

SEQ ID NO: 3207 - protein, 7 aa, synthetic construct
EVSNRPS

SEQ ID NO: 3208 - protein, 7 aa, synthetic construct
EDSKRPS

SEQ ID NO: 3209 - protein, 7 aa, synthetic construct
GNSNRPS

SEQ ID NO: 3210 - protein, 7 aa, synthetic construct
KDSERPS

SEQ ID NO: 3211 - protein, 7 aa, synthetic construct
EDSKRPS

SEQ ID NO: 3212 - protein, 7 aa, synthetic construct
GNSNRPS

SEQ ID NO: 3213 - protein, 7 aa, synthetic construct
EVSKRPS

SEQ ID NO: 3214 - protein, 7 aa, synthetic construct
DVSKRPS

SEQ ID NO: 3215 - protein, 7 aa, synthetic construct
GKNNRPS

SEQ ID NO: 3216 - protein, 7 aa, synthetic construct
YDSDRPS

SEQ ID NO: 3217 - protein, 7 aa, synthetic construct
SNNQRPS

SEQ ID NO: 3218 - protein, 7 aa, synthetic construct
EVSKRPS

SEQ ID NO: 3219 - protein, 7 aa, synthetic construct
YDDLLPS

SEQ ID NO: 3220 - protein, 7 aa, synthetic construct
RDSNRPS

SEQ ID NO: 3221 - protein, 7 aa, synthetic construct
EDSKRPS

SEQ ID NO: 3222 - protein, 7 aa, synthetic construct
EVIKRPS

SEQ ID NO: 3223 - protein, 7 aa, synthetic construct
QDSKRPS

SEQ ID NO: 3224 - protein, 7 aa, synthetic construct
KDSERPS

SEQ ID NO: 3225 - protein, 7 aa, synthetic construct
EDSKRPS

SEQ ID NO: 3226 - protein, 7 aa, synthetic construct
EDSKRPS

SEQ ID NO: 3227 - protein, 7 aa, synthetic construct
EDSKRPS

SEQ ID NO: 3228 - protein, 7 aa, synthetic construct
EDSKRPS

SEQ ID NO: 3229 - protein, 7 aa, synthetic construct
EVSDRPS

SEQ ID NO: 3230 - protein, 7 aa, synthetic construct
EVSNRPS

SEQ ID NO: 3231 - protein, 7 aa, synthetic construct
DVSKRPS

SEQ ID NO: 3232 - protein, 7 aa, synthetic construct
KDSERPS

SEQ ID NO: 3233 - protein, 7 aa, synthetic construct
KDSERPS

SEQ ID NO: 3234 - protein, 7 aa, synthetic construct
EDSKRPS

SEQ ID NO: 3235 - protein, 7 aa, synthetic construct
EDSKRPS

SEQ ID NO: 3236 - protein, 7 aa, synthetic construct
EDSKRPS

SEQ ID NO: 3237 - protein, 7 aa, synthetic construct
EDSKRPS

SEQ ID NO: 3238 - protein, 7 aa, synthetic construct
EDSKRPS

SEQ ID NO: 3239 - protein, 7 aa, synthetic construct
RDSNRPS

SEQ ID NO: 3240 - protein, 7 aa, synthetic construct
GKNNRPS

SEQ ID NO: 3241 - protein, 7 aa, synthetic construct
STSNKHS

SEQ ID NO: 3242 - protein, 7 aa, synthetic construct
SNNQRPS

SEQ ID NO: 3243 - protein, 7 aa, synthetic construct
QDSKRPS

SEQ ID NO: 3244 - protein, 7 aa, synthetic construct
QDSKRPS

SEQ ID NO: 3245 - protein, 7 aa, synthetic construct
QDSKRPS

SEQ ID NO: 3246 - protein, 7 aa, synthetic construct
EDSKRPS

SEQ ID NO: 3247 - protein, 7 aa, synthetic construct
EDSKRPS

SEQ ID NO: 3248 - protein, 7 aa, synthetic construct
EDSKRPS

SEQ ID NO: 3249 - protein, 7 aa, synthetic construct
EDSKRPS

SEQ ID NO: 3250 - protein, 7 aa, synthetic construct
EDSKRPS

SEQ ID NO: 3251 - protein, 7 aa, synthetic construct
EDSKRPS

SEQ ID NO: 3252 - protein, 7 aa, synthetic construct
EDSKRPS

SEQ ID NO: 3253 - protein, 7 aa, synthetic construct
GKNNRPS

SEQ ID NO: 3254 - protein, 7 aa, synthetic construct
GKNNRPS

SEQ ID NO: 3255 - protein, 7 aa, synthetic construct
EDSKRPS

SEQ ID NO: 3256 - protein, 7 aa, synthetic construct
DVSNRPS

SEQ ID NO: 3257 - protein, 7 aa, synthetic construct
EVSNRPS

SEQ ID NO: 3258 - protein, 7 aa, synthetic construct
EVSNRPS

SEQ ID NO: 3259 - protein, 11 aa, synthetic construct
YKSDSDKQQGS

SEQ ID NO: 3260 - protein, 7 aa, synthetic construct
QDSKRPS

SEQ ID NO: 3261 - protein, 7 aa, synthetic construct
QDSKRPS

SEQ ID NO: 3262 - protein, 7 aa, synthetic construct
KDSERPS

SEQ ID NO: 3263 - protein, 7 aa, synthetic construct
KDSERPS

SEQ ID NO: 3264 - protein, 7 aa, synthetic construct
EDSKRPS

SEQ ID NO: 3265 - protein, 7 aa, synthetic construct
EDSKRPS

SEQ ID NO: 3266 - protein, 7 aa, synthetic construct
GKNNRPS

SEQ ID NO: 3267 - protein, 7 aa, synthetic construct
EDSKRPS

SEQ ID NO: 3268 - protein, 7 aa, synthetic construct
EDSKRPS

SEQ ID NO: 3269 - protein, 7 aa, synthetic construct
STSNKHS

SEQ ID NO: 3270 - protein, 7 aa, synthetic construct
EVSKRPS

SEQ ID NO: 3271 - protein, 7 aa, synthetic construct
DNNNRPS

SEQ ID NO: 3272 - protein, 7 aa, synthetic construct
GKNNRPS

SEQ ID NO: 3273 - protein, 7 aa, synthetic construct
GKNNRPS

SEQ ID NO: 3274 - protein, 7 aa, synthetic construct
GKNNRPS

SEQ ID NO: 3275 - protein, 7 aa, synthetic construct
EDSKRPS

SEQ ID NO: 3276 - protein, 7 aa, synthetic construct
GKNNRPS

SEQ ID NO: 3277 - protein, 7 aa, synthetic construct
EDSKRPS

SEQ ID NO: 3278 - protein, 7 aa, synthetic construct
EDSKRPS

SEQ ID NO: 3279 - protein, 7 aa, synthetic construct
EDSKRPS

SEQ ID NO: 3280 - protein, 7 aa, synthetic construct
GKNNRPS

SEQ ID NO: 3281 - protein, 7 aa, synthetic construct
YDSDRPS

SEQ ID NO: 3282 - protein, 7 aa, synthetic construct
GKNNRPS

SEQ ID NO: 3283 - protein, 7 aa, synthetic construct
GKNNRPS

SEQ ID NO: 3284 - protein, 7 aa, synthetic construct
EDSKRPS

SEQ ID NO: 3285 - protein, 7 aa, synthetic construct
STSNKHS

SEQ ID NO: 3286 - protein, 7 aa, synthetic construct
EVIIRPS

SEQ ID NO: 3287 - protein, 7 aa, synthetic construct
EVSNRPS

SEQ ID NO: 3288 - protein, 7 aa, synthetic construct
EVSNRPS

SEQ ID NO: 3289 - protein, 7 aa, synthetic construct
QDSKRPS

SEQ ID NO: 3290 - protein, 7 aa, synthetic construct
EDSKRPS

SEQ ID NO: 3291 - protein, 7 aa, synthetic construct
YDSDRPS

SEQ ID NO: 3292 - protein, 7 aa, synthetic construct
EDSKRPS

SEQ ID NO: 3293 - protein, 7 aa, synthetic construct
EDSKRPS

SEQ ID NO: 3294 - protein, 7 aa, synthetic construct
STSNKHS

SEQ ID NO: 3295 - protein, 7 aa, synthetic construct
DVSKRPS

SEQ ID NO: 3296 - protein, 7 aa, synthetic construct
HDVLLSS

SEQ ID NO: 3297 - protein, 7 aa, synthetic construct
SNNQRPS

SEQ ID NO: 3298 - protein, 7 aa, synthetic construct
YDDLLPS

SEQ ID NO: 3299 - protein, 7 aa, synthetic construct
EVSKRPS

SEQ ID NO: 3300 - protein, 7 aa, synthetic construct
GNRNRPS

SEQ ID NO: 3301 - protein, 7 aa, synthetic construct
KDSERPS

SEQ ID NO: 3302 - protein, 7 aa, synthetic construct
QDSKRPS

SEQ ID NO: 3303 - protein, 7 aa, synthetic construct
GKNNRPS

SEQ ID NO: 3304 - protein, 7 aa, synthetic construct
YDSDRPS

SEQ ID NO: 3305 - protein, 7 aa, synthetic construct
GKNNRPS

SEQ ID NO: 3306 - protein, 7 aa, synthetic construct
GKNNRPS

SEQ ID NO: 3307 - protein, 7 aa, synthetic construct
DVSKRPS

SEQ ID NO: 3308 - protein, 7 aa, synthetic construct
QDSKRPS

SEQ ID NO: 3309 - protein, 7 aa, synthetic construct
QDSKRPS

SEQ ID NO: 3310 - protein, 7 aa, synthetic construct
QDSKRPS

SEQ ID NO: 3311 - protein, 7 aa, synthetic construct
RDGNRPS

SEQ ID NO: 3312 - protein, 7 aa, synthetic construct
EDSKRPS

SEQ ID NO: 3313 - protein, 7 aa, synthetic construct
EDSKRPS

SEQ ID NO: 3314 - protein, 7 aa, synthetic construct
SNDQRPL

SEQ ID NO: 3315 - protein, 7 aa, synthetic construct
ANIIRPS

SEQ ID NO: 3316 - protein, 7 aa, synthetic construct
EDSKRPS

SEQ ID NO: 3317 - protein, 7 aa, synthetic construct
EDSKRPS

SEQ ID NO: 3318 - protein, 7 aa, synthetic construct
GKNNRPS

SEQ ID NO: 3319 - protein, 7 aa, synthetic construct
EDSKRPS

SEQ ID NO: 3320 - protein, 7 aa, synthetic construct
EDSKRPS

SEQ ID NO: 3321 - protein, 7 aa, synthetic construct
GKNNRPS

SEQ ID NO: 3322 - protein, 7 aa, synthetic construct
EDSKRPS

SEQ ID NO: 3323 - protein, 7 aa, synthetic construct
YDSDRPS

SEQ ID NO: 3324 - protein, 7 aa, synthetic construct
EDSKRPS

SEQ ID NO: 3325 - protein, 7 aa, synthetic construct
EVSNRPS

SEQ ID NO: 3326 - protein, 7 aa, synthetic construct
EVSNRPS

SEQ ID NO: 3327 - protein, 7 aa, synthetic construct
GKNNRPS

SEQ ID NO: 3328 - protein, 7 aa, synthetic construct
GNINRPS

SEQ ID NO: 3329 - protein, 7 aa, synthetic construct
IYGNLNR

SEQ ID NO: 3330 - protein, 11 aa, synthetic construct
YKSDSDKQQGS

SEQ ID NO: 3331 - protein, 7 aa, synthetic construct
QDSKRPS

SEQ ID NO: 3332 - protein, 7 aa, synthetic construct
YDSDRPS

SEQ ID NO: 3333 - protein, 7 aa, synthetic construct
EDSKRPS

SEQ ID NO: 3334 - protein, 7 aa, synthetic construct
QDSKRPS

SEQ ID NO: 3335 - protein, 7 aa, synthetic construct
GNSNRPS

SEQ ID NO: 3336 - protein, 7 aa, synthetic construct
GYTFTSY

SEQ ID NO: 3337 - protein, 7 aa, synthetic construct
GGTFSSY

SEQ ID NO: 3338 - protein, 9 aa, synthetic construct
GGSISSSSY

SEQ ID NO: 3339 - protein, 7 aa, synthetic construct
GFTFSSY

SEQ ID NO: 3340 - protein, 7 aa, synthetic construct
GFTFSSY

SEQ ID NO: 3341 - protein, 7 aa, synthetic construct
GFTFSDY

SEQ ID NO: 3342 - protein, 7 aa, synthetic construct
GFTFSTD

SEQ ID NO: 3343 - protein, 7 aa, synthetic construct
GFTVSSN

SEQ ID NO: 3344 - protein, 9 aa, synthetic construct
GGSISSSSY

SEQ ID NO: 3345 - protein, 7 aa, synthetic construct
GYTFTSY

SEQ ID NO: 3346 - protein, 7 aa, synthetic construct
GFTFSSY

SEQ ID NO: 3347 - protein, 7 aa, synthetic construct
GYTFTSY

SEQ ID NO: 3348 - protein, 7 aa, synthetic construct
GFTFSSY

SEQ ID NO: 3349 - protein, 7 aa, synthetic construct
GFTFSSY

SEQ ID NO: 3350 - protein, 7 aa, synthetic construct
GFTFSSY

SEQ ID NO: 3351 - protein, 7 aa, synthetic construct
GYTFISY

SEQ ID NO: 3352 - protein, 7 aa, synthetic construct
GFTVSSN

SEQ ID NO: 3353 - protein, 7 aa, synthetic construct
GFTFSSY

SEQ ID NO: 3354 - protein, 7 aa, synthetic construct
GFTVSSN

SEQ ID NO: 3355 - protein, 9 aa, synthetic construct
GDSVSSNSA

SEQ ID NO: 3356 - protein, 7 aa, synthetic construct
GYSFSSY

SEQ ID NO: 3357 - protein, 7 aa, synthetic construct
GFTFSSY

SEQ ID NO: 3358 - protein, 7 aa, synthetic construct
GFTFSSY

SEQ ID NO: 3359 - protein, 7 aa, synthetic construct
GGSISSY

SEQ ID NO: 3360 - protein, 7 aa, synthetic construct
GFTFINA

SEQ ID NO: 3361 - protein, 7 aa, synthetic construct
GFTFSNA

SEQ ID NO: 3362 - protein, 7 aa, synthetic construct
GFTFSNA

SEQ ID NO: 3363 - protein, 7 aa, synthetic construct
GYTFTSY

SEQ ID NO: 3364 - protein, 7 aa, synthetic construct
GFTFSTY

SEQ ID NO: 3365 - protein, 7 aa, synthetic construct
GFTFSSY

SEQ ID NO: 3366 - protein, 7 aa, synthetic construct
GFTFSRY

SEQ ID NO: 3367 - protein, 7 aa, synthetic construct
GFTFSRC

SEQ ID NO: 3368 - protein, 7 aa, synthetic construct
GFTFINY

SEQ ID NO: 3369 - protein, 7 aa, synthetic construct
GFTFSSY

SEQ ID NO: 3370 - protein, 7 aa, synthetic construct
GFTFDDY

SEQ ID NO: 3371 - protein, 7 aa, synthetic construct
GYTFTSY

SEQ ID NO: 3372 - protein, 7 aa, synthetic construct
GYTFTSY

SEQ ID NO: 3373 - protein, 7 aa, synthetic construct
GFTFSSY

SEQ ID NO: 3374 - protein, 7 aa, synthetic construct
GFTFSSY

SEQ ID NO: 3375 - protein, 7 aa, synthetic construct
GFTFSSY

SEQ ID NO: 3376 - protein, 7 aa, synthetic construct
GFSFSSH

SEQ ID NO: 3377 - protein, 7 aa, synthetic construct
GFTFSSY

SEQ ID NO: 3378 - protein, 7 aa, synthetic construct
GYTFTSY

SEQ ID NO: 3379 - protein, 7 aa, synthetic construct
GFTFSSY

SEQ ID NO: 3380 - protein, 7 aa, synthetic construct
GYTFTSY

SEQ ID NO: 3381 - protein, 7 aa, synthetic construct
GYTFTNY

SEQ ID NO: 3382 - protein, 7 aa, synthetic construct
GFTFSSY

SEQ ID NO: 3383 - protein, 7 aa, synthetic construct
GFTFSSY

SEQ ID NO: 3384 - protein, 7 aa, synthetic construct
GYTFTSY

SEQ ID NO: 3385 - protein, 7 aa, synthetic construct
GYTFTSY

SEQ ID NO: 3386 - protein, 7 aa, synthetic construct
GFTFSNA

SEQ ID NO: 3387 - protein, 7 aa, synthetic construct
GFTFSNY

SEQ ID NO: 3388 - protein, 7 aa, synthetic construct
GFTFSSY

SEQ ID NO: 3389 - protein, 7 aa, synthetic construct
GFTFDDY

SEQ ID NO: 3390 - protein, 7 aa, synthetic construct
GFTFSSY

SEQ ID NO: 3391 - protein, 7 aa, synthetic construct
GFTFSSY

SEQ ID NO: 3392 - protein, 7 aa, synthetic construct
GFTFSSY

SEQ ID NO: 3393 - protein, 7 aa, synthetic construct
GFPFDDF

SEQ ID NO: 3394 - protein, 7 aa, synthetic construct
GFSISIN

SEQ ID NO: 3395 - protein, 7 aa, synthetic construct
GFTFSSY

SEQ ID NO: 3396 - protein, 7 aa, synthetic construct
GFTFSTY

SEQ ID NO: 3397 - protein, 7 aa, synthetic construct
GFTFSSY

SEQ ID NO: 3398 - protein, 7 aa, synthetic construct
GYTFTTY

SEQ ID NO: 3399 - protein, 7 aa, synthetic construct
GFTFSSY

SEQ ID NO: 3400 - protein, 7 aa, synthetic construct
GFTFNRY

SEQ ID NO: 3401 - protein, 8 aa, synthetic construct
GGSISSSN

SEQ ID NO: 3402 - protein, 7 aa, synthetic construct
GFTFSIY

SEQ ID NO: 3403 - protein, 7 aa, synthetic construct
GFTFSGY

SEQ ID NO: 3404 - protein, 7 aa, synthetic construct
GYTFTTY

SEQ ID NO: 3405 - protein, 7 aa, synthetic construct
GFTFSSY

SEQ ID NO: 3406 - protein, 7 aa, synthetic construct
GFTFSNA

SEQ ID NO: 3407 - protein, 7 aa, synthetic construct
GFTFSSY

SEQ ID NO: 3408 - protein, 7 aa, synthetic construct
GFTFSSY

SEQ ID NO: 3409 - protein, 7 aa, synthetic construct
GFTFSSY

SEQ ID NO: 3410 - protein, 7 aa, synthetic construct
GFTFSSY

SEQ ID NO: 3411 - protein, 7 aa, synthetic construct
GYTFTGY

SEQ ID NO: 3412 - protein, 7 aa, synthetic construct
GFTFSNA

SEQ ID NO: 3413 - protein, 7 aa, synthetic construct
GYTFTGY

SEQ ID NO: 3414 - protein, 7 aa, synthetic construct
GYTFTSY

SEQ ID NO: 3415 - protein, 7 aa, synthetic construct
GFTFSNA

SEQ ID NO: 3416 - protein, 7 aa, synthetic construct
GFTFSGY

SEQ ID NO: 3417 - protein, 7 aa, synthetic construct
GYTFTSY

SEQ ID NO: 3418 - protein, 7 aa, synthetic construct
GFTFSSY

SEQ ID NO: 3419 - protein, 7 aa, synthetic construct
GGSISDY

SEQ ID NO: 3420 - protein, 7 aa, synthetic construct
GFTFSSD

SEQ ID NO: 3421 - protein, 7 aa, synthetic construct
GFTFSSY

SEQ ID NO: 3422 - protein, 7 aa, synthetic construct
GFTFSSY

SEQ ID NO: 3423 - protein, 7 aa, synthetic construct
GYTFTSY

SEQ ID NO: 3424 - protein, 7 aa, synthetic construct
GYTFTDH

SEQ ID NO: 3425 - protein, 7 aa, synthetic construct
GYTFTGY

SEQ ID NO: 3426 - protein, 7 aa, synthetic construct
GFTFSSY

SEQ ID NO: 3427 - protein, 9 aa, synthetic construct
GDNVSSNSA

SEQ ID NO: 3428 - protein, 7 aa, synthetic construct
GYTFTSY

SEQ ID NO: 3429 - protein, 7 aa, synthetic construct
GYTFTGY

SEQ ID NO: 3430 - protein, 7 aa, synthetic construct
GFTFSRY

SEQ ID NO: 3431 - protein, 7 aa, synthetic construct
GFTFDEY

SEQ ID NO: 3432 - protein, 7 aa, synthetic construct
GFTFSSY

SEQ ID NO: 3433 - protein, 9 aa, synthetic construct
GFSISTSGV

SEQ ID NO: 3434 - protein, 7 aa, synthetic construct
GFTFDDY

SEQ ID NO: 3435 - protein, 7 aa, synthetic construct
GYTFTSY

SEQ ID NO: 3436 - protein, 7 aa, synthetic construct
GFTFSSY

SEQ ID NO: 3437 - protein, 7 aa, synthetic construct
GFTFSSY

SEQ ID NO: 3438 - protein, 9 aa, synthetic construct
GDSVSSNSA

SEQ ID NO: 3439 - protein, 7 aa, synthetic construct
GFTFSTY

SEQ ID NO: 3440 - protein, 9 aa, synthetic construct
GFSLSTSGM

SEQ ID NO: 3441 - protein, 7 aa, synthetic construct
EFIFRSY

SEQ ID NO: 3442 - protein, 7 aa, synthetic construct
GFTFSDY

SEQ ID NO: 3443 - protein, 7 aa, synthetic construct
GFTFSSY

SEQ ID NO: 3444 - protein, 7 aa, synthetic construct
GYTFTSY

SEQ ID NO: 3445 - protein, 9 aa, synthetic construct
GGSISSGGY

SEQ ID NO: 3446 - protein, 7 aa, synthetic construct
GFTFSSY

SEQ ID NO: 3447 - protein, 7 aa, synthetic construct
GFTFSSY

SEQ ID NO: 3448 - protein, 7 aa, synthetic construct
GFTFSSY

SEQ ID NO: 3449 - protein, 7 aa, synthetic construct
GFTFSSY

SEQ ID NO: 3450 - protein, 7 aa, synthetic construct
GFTFRNA

SEQ ID NO: 3451 - protein, 7 aa, synthetic construct
GYTFTSY

SEQ ID NO: 3452 - protein, 9 aa, synthetic construct
GDSVSSNSA

SEQ ID NO: 3453 - protein, 7 aa, synthetic construct
GFTFSSY

SEQ ID NO: 3454 - protein, 7 aa, synthetic construct
GFTFSSY

SEQ ID NO: 3455 - protein, 7 aa, synthetic construct
GFTFSNA

SEQ ID NO: 3456 - protein, 9 aa, synthetic construct
GDSVSSNSA

SEQ ID NO: 3457 - protein, 7 aa, synthetic construct
GFTFSSY

SEQ ID NO: 3458 - protein, 9 aa, synthetic construct
GGSITTRSY

SEQ ID NO: 3459 - protein, 9 aa, synthetic construct
GGSISTRSY

SEQ ID NO: 3460 - protein, 7 aa, synthetic construct
GGSFSGH

SEQ ID NO: 3461 - protein, 7 aa, synthetic construct
GGFLRGY

SEQ ID NO: 3462 - protein, 7 aa, synthetic construct
GYIFSNY

SEQ ID NO: 3463 - protein, 7 aa, synthetic construct
GFTFSSY

SEQ ID NO: 3464 - protein, 7 aa, synthetic construct
GFTFTSY

SEQ ID NO: 3465 - protein, 9 aa, synthetic construct
GGSISTRSY

SEQ ID NO: 3466 - protein, 7 aa, synthetic construct
GGSFSVY

SEQ ID NO: 3467 - protein, 9 aa, synthetic construct
GGSISSIIY

SEQ ID NO: 3468 - protein, 7 aa, synthetic construct
GGSFSGY

SEQ ID NO: 3469 - protein, 7 aa, synthetic construct
GGSFSGY

SEQ ID NO: 3470 - protein, 7 aa, synthetic construct
GYTFITY

SEQ ID NO: 3471 - protein, 7 aa, synthetic construct
GYTFITY

SEQ ID NO: 3472 - protein, 6 aa, synthetic construct
NPNSGN

SEQ ID NO: 3473 - protein, 6 aa, synthetic construct
IPIFGT

SEQ ID NO: 3474 - protein, 5 aa, synthetic construct
YYSGS

SEQ ID NO: 3475 - protein, 6 aa, synthetic construct
SSSSTY

SEQ ID NO: 3476 - protein, 5 aa, synthetic construct
GTAGD

SEQ ID NO: 3477 - protein, 6 aa, synthetic construct
SSSGST

SEQ ID NO: 3478 - protein, 6 aa, synthetic construct
SGSSSY

SEQ ID NO: 3479 - protein, 5 aa, synthetic construct
YSGGS

SEQ ID NO: 3480 - protein, 5 aa, synthetic construct
YYSGS

SEQ ID NO: 3481 - protein, 6 aa, synthetic construct
SAYNGN

SEQ ID NO: 3482 - protein, 6 aa, synthetic construct
KQDGSE

SEQ ID NO: 3483 - protein, 6 aa, synthetic construct
NPNSGN

SEQ ID NO: 3484 - protein, 5 aa, synthetic construct
GTAGD

SEQ ID NO: 3485 - protein, 6 aa, synthetic construct
SSSSSY

SEQ ID NO: 3486 - protein, 6 aa, synthetic construct
SSSSSY

SEQ ID NO: 3487 - protein, 6 aa, synthetic construct
NTNTGN

SEQ ID NO: 3488 - protein, 5 aa, synthetic construct
YSGGS

SEQ ID NO: 3489 - protein, 6 aa, synthetic construct
SSSSSY

SEQ ID NO: 3490 - protein, 5 aa, synthetic construct
YSGGS

SEQ ID NO: 3491 - protein, 7 aa, synthetic construct
YYRSKWY

SEQ ID NO: 3492 - protein, 6 aa, synthetic construct
YPGDSD

SEQ ID NO: 3493 - protein, 6 aa, synthetic construct
NSDGSS

SEQ ID NO: 3494 - protein, 6 aa, synthetic construct
KQDGSE

SEQ ID NO: 3495 - protein, 5 aa, synthetic construct
YYSGS

SEQ ID NO: 3496 - protein, 8 aa, synthetic construct
KSKTDGGT

SEQ ID NO: 3497 - protein, 8 aa, synthetic construct
KSKTDGGT

SEQ ID NO: 3498 - protein, 8 aa, synthetic construct
KSKTDGGT

SEQ ID NO: 3499 - protein, 6 aa, synthetic construct
SAYNGN

SEQ ID NO: 3500 - protein, 6 aa, synthetic construct
SGGGGS

SEQ ID NO: 3501 - protein, 5 aa, synthetic construct
GTAGD

SEQ ID NO: 3502 - protein, 6 aa, synthetic construct
NQDGSE

SEQ ID NO: 3503 - protein, 5 aa, synthetic construct
GAAGD

SEQ ID NO: 3504 - protein, 6 aa, synthetic construct
WYDGSN

SEQ ID NO: 3505 - protein, 6 aa, synthetic construct
NSDGSS

SEQ ID NO: 3506 - protein, 6 aa, synthetic construct
SWNSGS

SEQ ID NO: 3507 - protein, 6 aa, synthetic construct
SAYNGN

SEQ ID NO: 3508 - protein, 6 aa, synthetic construct
NPSGGS

SEQ ID NO: 3509 - protein, 5 aa, synthetic construct
GTAGD

SEQ ID NO: 3510 - protein, 6 aa, synthetic construct
SGSGGS

SEQ ID NO: 3511 - protein, 6 aa, synthetic construct
WYDGSN

SEQ ID NO: 3512 - protein, 6 aa, synthetic construct
SGISNY

SEQ ID NO: 3513 - protein, 6 aa, synthetic construct
SGSGGN

SEQ ID NO: 3514 - protein, 6 aa, synthetic construct
NPSGGT

SEQ ID NO: 3515 - protein, 6 aa, synthetic construct
KQDGSE

SEQ ID NO: 3516 - protein, 6 aa, synthetic construct
SAYNGN

SEQ ID NO: 3517 - protein, 6 aa, synthetic construct
SAYNGN

SEQ ID NO: 3518 - protein, 6 aa, synthetic construct
SSSSST

SEQ ID NO: 3519 - protein, 5 aa, synthetic construct
GTAGD

SEQ ID NO: 3520 - protein, 6 aa, synthetic construct
IPNSGN

SEQ ID NO: 3521 - protein, 6 aa, synthetic construct
NPSGGS

SEQ ID NO: 3522 - protein, 8 aa, synthetic construct
KSKTDGGT

SEQ ID NO: 3523 - protein, 6 aa, synthetic construct
WYDGNN

SEQ ID NO: 3524 - protein, 6 aa, synthetic construct
WYDGSN

SEQ ID NO: 3525 - protein, 6 aa, synthetic construct
NWNGGS

SEQ ID NO: 3526 - protein, 6 aa, synthetic construct
SSSSSY

SEQ ID NO: 3527 - protein, 6 aa, synthetic construct
SGSGGS

SEQ ID NO: 3528 - protein, 5 aa, synthetic construct
GTAGD

SEQ ID NO: 3529 - protein, 6 aa, synthetic construct
NWNGGT

SEQ ID NO: 3530 - protein, 6 aa, synthetic construct
SSSSTY

SEQ ID NO: 3531 - protein, 6 aa, synthetic construct
NSDGSS

SEQ ID NO: 3532 - protein, 6 aa, synthetic construct
SSSSTY

SEQ ID NO: 3533 - protein, 6 aa, synthetic construct
SGSGGS

SEQ ID NO: 3534 - protein, 6 aa, synthetic construct
SGYSGY

SEQ ID NO: 3535 - protein, 6 aa, synthetic construct
SRSSGT

SEQ ID NO: 3536 - protein, 6 aa, synthetic construct
SSSSDT

SEQ ID NO: 3537 - protein, 5 aa, synthetic construct
YHSGS

SEQ ID NO: 3538 - protein, 6 aa, synthetic construct
NLDGSE

SEQ ID NO: 3539 - protein, 6 aa, synthetic construct
KHDGSE

SEQ ID NO: 3540 - protein, 6 aa, synthetic construct
SAFNGN

SEQ ID NO: 3541 - protein, 5 aa, synthetic construct
GTAGD

SEQ ID NO: 3542 - protein, 8 aa, synthetic construct
KSKTDGGT

SEQ ID NO: 3543 - protein, 6 aa, synthetic construct
SGGGGS

SEQ ID NO: 3544 - protein, 6 aa, synthetic construct
WYDGSN

SEQ ID NO: 3545 - protein, 6 aa, synthetic construct
SSSSSY

SEQ ID NO: 3546 - protein, 6 aa, synthetic construct
SSSSSY

SEQ ID NO: 3547 - protein, 6 aa, synthetic construct
NPNSGG

SEQ ID NO: 3548 - protein, 8 aa, synthetic construct
KSKTDGGT

SEQ ID NO: 3549 - protein, 6 aa, synthetic construct
NPNSGG

SEQ ID NO: 3550 - protein, 6 aa, synthetic construct
NPNSGN

SEQ ID NO: 3551 - protein, 8 aa, synthetic construct
KSKTDGGT

SEQ ID NO: 3552 - protein, 6 aa, synthetic construct
KQDGSD

SEQ ID NO: 3553 - protein, 6 aa, synthetic construct
NPNSGN

SEQ ID NO: 3554 - protein, 6 aa, synthetic construct
WYDGSN

SEQ ID NO: 3555 - protein, 5 aa, synthetic construct
SSRGR

SEQ ID NO: 3556 - protein, 6 aa, synthetic construct
GSSSSY

SEQ ID NO: 3557 - protein, 6 aa, synthetic construct
SSSSSY

SEQ ID NO: 3558 - protein, 6 aa, synthetic construct
SSSSSY

SEQ ID NO: 3559 - protein, 6 aa, synthetic construct
SAYNGN

SEQ ID NO: 3560 - protein, 6 aa, synthetic construct
NPNSGG

SEQ ID NO: 3561 - protein, 6 aa, synthetic construct
NPNSGG

SEQ ID NO: 3562 - protein, 6 aa, synthetic construct
NSDGSN

SEQ ID NO: 3563 - protein, 7 aa, synthetic construct
YYRSKWY

SEQ ID NO: 3564 - protein, 6 aa, synthetic construct
SAYNGN

SEQ ID NO: 3565 - protein, 6 aa, synthetic construct
NPNSGG

SEQ ID NO: 3566 - protein, 6 aa, synthetic construct
ISSTSY

SEQ ID NO: 3567 - protein, 6 aa, synthetic construct
SWNSGS

SEQ ID NO: 3568 - protein, 6 aa, synthetic construct
WYDGSN

SEQ ID NO: 3569 - protein, 5 aa, synthetic construct
FWNDD

SEQ ID NO: 3570 - protein, 6 aa, synthetic construct
NWNGGS

SEQ ID NO: 3571 - protein, 6 aa, synthetic construct
NPNSGN

SEQ ID NO: 3572 - protein, 6 aa, synthetic construct
SSSSSY

SEQ ID NO: 3573 - protein, 6 aa, synthetic construct
KQDGSE

SEQ ID NO: 3574 - protein, 7 aa, synthetic construct
YYRSKWY

SEQ ID NO: 3575 - protein, 6 aa, synthetic construct
SSSSTY

SEQ ID NO: 3576 - protein, 5 aa, synthetic construct
DWDDD

SEQ ID NO: 3577 - protein, 6 aa, synthetic construct
SISSRT

SEQ ID NO: 3578 - protein, 6 aa, synthetic construct
SSSGST

SEQ ID NO: 3579 - protein, 6 aa, synthetic construct
SSSSST

SEQ ID NO: 3580 - protein, 6 aa, synthetic construct
NPNSGN

SEQ ID NO: 3581 - protein, 5 aa, synthetic construct
YYSGS

SEQ ID NO: 3582 - protein, 6 aa, synthetic construct
KQDGSE

SEQ ID NO: 3583 - protein, 6 aa, synthetic construct
SSSSST

SEQ ID NO: 3584 - protein, 6 aa, synthetic construct
SGSGGS

SEQ ID NO: 3585 - protein, 6 aa, synthetic construct
WYDGSN

SEQ ID NO: 3586 - protein, 8 aa, synthetic construct
KTKTDGGA

SEQ ID NO: 3587 - protein, 6 aa, synthetic construct
SAYNGN

SEQ ID NO: 3588 - protein, 7 aa, synthetic construct
YYRSKWY

SEQ ID NO: 3589 - protein, 6 aa, synthetic construct
SSSSSY

SEQ ID NO: 3590 - protein, 6 aa, synthetic construct
SSSTST

SEQ ID NO: 3591 - protein, 8 aa, synthetic construct
KSKTDGGT

SEQ ID NO: 3592 - protein, 7 aa, synthetic construct
YYRSKWY

SEQ ID NO: 3593 - protein, 6 aa, synthetic construct
KQDGSE

SEQ ID NO: 3594 - protein, 5 aa, synthetic construct
YYSGN

SEQ ID NO: 3595 - protein, 5 aa, synthetic construct
YYSGS

SEQ ID NO: 3596 - protein, 5 aa, synthetic construct
NHSGF

SEQ ID NO: 3597 - protein, 5 aa, synthetic construct
NHSGS

SEQ ID NO: 3598 - protein, 6 aa, synthetic construct
NPYNVN

SEQ ID NO: 3599 - protein, 6 aa, synthetic construct
SSSSSY

SEQ ID NO: 3600 - protein, 6 aa, synthetic construct
TPSGGT

SEQ ID NO: 3601 - protein, 5 aa, synthetic construct
FYSGS

SEQ ID NO: 3602 - protein, 5 aa, synthetic construct
NHSGS

SEQ ID NO: 3603 - protein, 5 aa, synthetic construct
YYSGS

SEQ ID NO: 3604 - protein, 5 aa, synthetic construct
NHSGN

SEQ ID NO: 3605 - protein, 5 aa, synthetic construct
NHSGS

SEQ ID NO: 3606 - protein, 6 aa, synthetic construct
SAYNGN

SEQ ID NO: 3607 - protein, 6 aa, synthetic construct
SSYNGN

SEQ ID NO: 3608 - protein, 11 aa, synthetic construct
SGDKLGDKYAC

SEQ ID NO: 3609 - protein, 14 aa, synthetic construct
TGTSSDVGGYNYVS

SEQ ID NO: 3610 - protein, 14 aa, synthetic construct
TGTSSDVGGYNYVS

SEQ ID NO: 3611 - protein, 14 aa, synthetic construct
TGTSSDVGGYNYVS

SEQ ID NO: 3612 - protein, 11 aa, synthetic construct
GGNNIGSKNVH

SEQ ID NO: 3613 - protein, 14 aa, synthetic construct
TGTSSDVGGYNYVS

SEQ ID NO: 3614 - protein, 11 aa, synthetic construct
SGDALPKKYAY

SEQ ID NO: 3615 - protein, 14 aa, synthetic construct
TGTSSDVGGYNYVS

SEQ ID NO: 3616 - protein, 12 aa, synthetic construct
TLSSEHSTYTIE

SEQ ID NO: 3617 - protein, 11 aa, synthetic construct
GGNNIGSKSVH

SEQ ID NO: 3618 - protein, 11 aa, synthetic construct
SGDKLGDKYAC

SEQ ID NO: 3619 - protein, 11 aa, synthetic construct
SGDKLGDKYAC

SEQ ID NO: 3620 - protein, 11 aa, synthetic construct
GGNNIGSKNVH

SEQ ID NO: 3621 - protein, 11 aa, synthetic construct
SGDVLAKKYAR

SEQ ID NO: 3622 - protein, 11 aa, synthetic construct
SGDALPKKYAY

SEQ ID NO: 3623 - protein, 14 aa, synthetic construct
GSSTGAVTSGHYPY

SEQ ID NO: 3624 - protein, 14 aa, synthetic construct
TGTSSDVGGYNYVS

SEQ ID NO: 3625 - protein, 14 aa, synthetic construct
TGTSSDVGGYNYVS

SEQ ID NO: 3626 - protein, 14 aa, synthetic construct
TGSSSNIGAGYDVH

SEQ ID NO: 3627 - protein, 14 aa, synthetic construct
TGTSSDVGGYNYVS

SEQ ID NO: 3628 - protein, 11 aa, synthetic construct
EGDNIGSESVH

SEQ ID NO: 3629 - protein, 14 aa, synthetic construct
TGTSSDVGGYNYVS

SEQ ID NO: 3630 - protein, 11 aa, synthetic construct
SGDALPKKYAY

SEQ ID NO: 3631 - protein, 11 aa, synthetic construct
SGDVLAKKYAR

SEQ ID NO: 3632 - protein, 11 aa, synthetic construct
SADALPNQYAY

SEQ ID NO: 3633 - protein, 11 aa, synthetic construct
SADALSKQYAY

SEQ ID NO: 3634 - protein, 11 aa, synthetic construct
SGDALPKKYAY

SEQ ID NO: 3635 - protein, 14 aa, synthetic construct
TGTSSDVGGYNYVS

SEQ ID NO: 3636 - protein, 14 aa, synthetic construct
TGTSSDVGGYNYVS

SEQ ID NO: 3637 - protein, 11 aa, synthetic construct
SGDALPKKYAY

SEQ ID NO: 3638 - protein, 14 aa, synthetic construct
TGTSSDVGGYDYVS

SEQ ID NO: 3639 - protein, 14 aa, synthetic construct
TLRSGINVGTYRIY

SEQ ID NO: 3640 - protein, 11 aa, synthetic construct
SGDVLAKKYAR

SEQ ID NO: 3641 - protein, 11 aa, synthetic construct
SGDVLAKKYAR

SEQ ID NO: 3642 - protein, 11 aa, synthetic construct
SGDALPKKYAY

SEQ ID NO: 3643 - protein, 11 aa, synthetic construct
SGDALPKKYAY

SEQ ID NO: 3644 - protein, 11 aa, synthetic construct
QGDSLRSYYAS

SEQ ID NO: 3645 - protein, 11 aa, synthetic construct
QGDSLRSYYAS

SEQ ID NO: 3646 - protein, 11 aa, synthetic construct
SGDALPKKYAY

SEQ ID NO: 3647 - protein, 11 aa, synthetic construct
SGDALPKKYAY

SEQ ID NO: 3648 - protein, 14 aa, synthetic construct
TGTNNDVGYYNYVS

SEQ ID NO: 3649 - protein, 14 aa, synthetic construct
TGTSSDVGGYNYVS

SEQ ID NO: 3650 - protein, 14 aa, synthetic construct
TGTSSDVGNYNYVS

SEQ ID NO: 3651 - protein, 14 aa, synthetic construct
TGSSSNIGAGYDVH

SEQ ID NO: 3652 - protein, 14 aa, synthetic construct
TGTSSDVGGYNYVS

SEQ ID NO: 3653 - protein, 14 aa, synthetic construct
TGTSSDVGGYNYVS

SEQ ID NO: 3654 - protein, 11 aa, synthetic construct
QGDSLRSYYAS

SEQ ID NO: 3655 - protein, 11 aa, synthetic construct
SGEALPKKYAY

SEQ ID NO: 3656 - protein, 14 aa, synthetic construct
TGTSSDVGGYNYVS

SEQ ID NO: 3657 - protein, 14 aa, synthetic construct
TGTSSDVGGYNYVS

SEQ ID NO: 3658 - protein, 14 aa, synthetic construct
TGTSSDVGGYNYVS

SEQ ID NO: 3659 - protein, 14 aa, synthetic construct
TGTSSDVGGYNYVS

SEQ ID NO: 3660 - protein, 14 aa, synthetic construct
TGTSSDVGGYNYVS

SEQ ID NO: 3661 - protein, 14 aa, synthetic construct
TGTSSDVGGYNYVS

SEQ ID NO: 3662 - protein, 14 aa, synthetic construct
TGTSSDVGGYNYVS

SEQ ID NO: 3663 - protein, 14 aa, synthetic construct
TGTSSDVGGYNYVS

SEQ ID NO: 3664 - protein, 11 aa, synthetic construct
SGDKLGDKYAC

SEQ ID NO: 3665 - protein, 11 aa, synthetic construct
SGDVLAKKYAR

SEQ ID NO: 3666 - protein, 11 aa, synthetic construct
SGDALPKKYAY

SEQ ID NO: 3667 - protein, 11 aa, synthetic construct
QGDSLRSYYAS

SEQ ID NO: 3668 - protein, 14 aa, synthetic construct
TGTSSDVGGYNYVS

SEQ ID NO: 3669 - protein, 14 aa, synthetic construct
TGSSSNIGAGYDVH

SEQ ID NO: 3670 - protein, 11 aa, synthetic construct
SRDKLGDKYAC

SEQ ID NO: 3671 - protein, 11 aa, synthetic construct
SGDKLGDRYAC

SEQ ID NO: 3672 - protein, 11 aa, synthetic construct
QGDSLRSYYAS

SEQ ID NO: 3673 - protein, 11 aa, synthetic construct
SGDKLENKYTC

SEQ ID NO: 3674 - protein, 11 aa, synthetic construct
QGDNIRNYYAS

SEQ ID NO: 3675 - protein, 11 aa, synthetic construct
QGDSLRRYYAS

SEQ ID NO: 3676 - protein, 11 aa, synthetic construct
QGDSLRSYYAS

SEQ ID NO: 3677 - protein, 11 aa, synthetic construct
SGDALPKKYAY

SEQ ID NO: 3678 - protein, 11 aa, synthetic construct
SGDALPKKYAY

SEQ ID NO: 3679 - protein, 11 aa, synthetic construct
SGDALPKKYAY

SEQ ID NO: 3680 - protein, 11 aa, synthetic construct
SGDALPKKYAY

SEQ ID NO: 3681 - protein, 14 aa, synthetic construct
TGTSSDVGGYNYVS

SEQ ID NO: 3682 - protein, 14 aa, synthetic construct
TGTSSDVGGYNYVS

SEQ ID NO: 3683 - protein, 14 aa, synthetic construct
TGTSSDVGGYNYVS

SEQ ID NO: 3684 - protein, 14 aa, synthetic construct
TGTSSDVGGYNYVS

SEQ ID NO: 3685 - protein, 11 aa, synthetic construct
SGDKLGDKYAC

SEQ ID NO: 3686 - protein, 11 aa, synthetic construct
SGDKLGDKYAC

SEQ ID NO: 3687 - protein, 11 aa, synthetic construct
SGDVLAKKYAR

SEQ ID NO: 3688 - protein, 11 aa, synthetic construct
SGDALPQKYAF

SEQ ID NO: 3689 - protein, 11 aa, synthetic construct
SGDALPKKYAY

SEQ ID NO: 3690 - protein, 11 aa, synthetic construct
SGDALPKKYAY

SEQ ID NO: 3691 - protein, 11 aa, synthetic construct
QGDSLRSYYAS

SEQ ID NO: 3692 - protein, 11 aa, synthetic construct
QGDSLRNYYAS

SEQ ID NO: 3693 - protein, 11 aa, synthetic construct
QGDSLRSYYAS

SEQ ID NO: 3694 - protein, 11 aa, synthetic construct
SGDALPKKYAY

SEQ ID NO: 3695 - protein, 11 aa, synthetic construct
QGDSLRSYYAS

SEQ ID NO: 3696 - protein, 11 aa, synthetic construct
QGDSLRSYYAS

SEQ ID NO: 3697 - protein, 11 aa, synthetic construct
QGDSLRSYYAS

SEQ ID NO: 3698 - protein, 11 aa, synthetic construct
QGDSLRSYYAS

SEQ ID NO: 3699 - protein, 11 aa, synthetic construct
QGDSLRSYYAS

SEQ ID NO: 3700 - protein, 13 aa, synthetic construct
SGSSSNIGYNAVN

SEQ ID NO: 3701 - protein, 14 aa, synthetic construct
TGTSSDVGGYNYVS

SEQ ID NO: 3702 - protein, 14 aa, synthetic construct
TGSSSNIGARYDVH

SEQ ID NO: 3703 - protein, 14 aa, synthetic construct
TGSSSNIGAGYDVH

SEQ ID NO: 3704 - protein, 14 aa, synthetic construct
TGSSSNIGAGYDVH

SEQ ID NO: 3705 - protein, 14 aa, synthetic construct
TLRSGINVGTSRIY

SEQ ID NO: 3706 - protein, 14 aa, synthetic construct
TLRSGINVGTYRIY

SEQ ID NO: 3707 - protein, 11 aa, synthetic construct
SGAKLGDKYAC

SEQ ID NO: 3708 - protein, 11 aa, synthetic construct
SGDALPKKYAY

SEQ ID NO: 3709 - protein, 11 aa, synthetic construct
QGDSLRSYYAS

SEQ ID NO: 3710 - protein, 11 aa, synthetic construct
SGDKLGDKYAC

SEQ ID NO: 3711 - protein, 11 aa, synthetic construct
QGDSLRSYYAS

SEQ ID NO: 3712 - protein, 11 aa, synthetic construct
SGDALPKKYAY

SEQ ID NO: 3713 - protein, 11 aa, synthetic construct
SGDALPKKYAY

SEQ ID NO: 3714 - protein, 11 aa, synthetic construct
SGDALPKKYAY

SEQ ID NO: 3715 - protein, 14 aa, synthetic construct
TGSSSNIGAGYDVH

SEQ ID NO: 3716 - protein, 14 aa, synthetic construct
TLRSGINVGTYRIY

SEQ ID NO: 3717 - protein, 11 aa, synthetic construct
SGDKLGDKYAC

SEQ ID NO: 3718 - protein, 11 aa, synthetic construct
QGDSLRRYYAS

SEQ ID NO: 3719 - protein, 11 aa, synthetic construct
SGDALPKKYAY

SEQ ID NO: 3720 - protein, 11 aa, synthetic construct
SGDALPKKYAY

SEQ ID NO: 3721 - protein, 11 aa, synthetic construct
GGNNIGGKSVH

SEQ ID NO: 3722 - protein, 13 aa, synthetic construct
SGSNSNIGFNTVN

SEQ ID NO: 3723 - protein, 14 aa, synthetic construct
TGTSSDVGGYNYVS

SEQ ID NO: 3724 - protein, 14 aa, synthetic construct
TGTSSDVGGYNYVS

SEQ ID NO: 3725 - protein, 11 aa, synthetic construct
SGDKLGNKYAC

SEQ ID NO: 3726 - protein, 11 aa, synthetic construct
SGDKLGDKYAC

SEQ ID NO: 3727 - protein, 11 aa, synthetic construct
SGDKLGDKYAC

SEQ ID NO: 3728 - protein, 11 aa, synthetic construct
SGDKLGDKYAC

SEQ ID NO: 3729 - protein, 11 aa, synthetic construct
SGDALPKKYAY

SEQ ID NO: 3730 - protein, 11 aa, synthetic construct
SGDALPKKYAY

SEQ ID NO: 3731 - protein, 13 aa, synthetic construct
SGSSSNIGINTVN

SEQ ID NO: 3732 - protein, 14 aa, synthetic construct
ASSTGAVTSGYYPN

SEQ ID NO: 3733 - protein, 14 aa, synthetic construct
TGTSSDVGGYNYVS

SEQ ID NO: 3734 - protein, 11 aa, synthetic construct
SGNLLAKKYPR

SEQ ID NO: 3735 - protein, 11 aa, synthetic construct
QGDSLRSYYAS

SEQ ID NO: 3736 - protein, 11 aa, synthetic construct
SGDALPKKYAY

SEQ ID NO: 3737 - protein, 14 aa, synthetic construct
TGTSSDVGGYNYVS

SEQ ID NO: 3738 - protein, 13 aa, synthetic construct
SGSSSNIGSKTVN

SEQ ID NO: 3739 - protein, 11 aa, synthetic construct
GENNIGSRNVH

SEQ ID NO: 3740 - protein, 11 aa, synthetic construct
QGDSLRSYYAS

SEQ ID NO: 3741 - protein, 11 aa, synthetic construct
SGDALPKKYAY

SEQ ID NO: 3742 - protein, 14 aa, synthetic construct
TGTSSDVGGYNYVS

SEQ ID NO: 3743 - protein, 14 aa, synthetic construct
TGTSSDVGGYNHVS

SEQ ID NO: 3744 - protein, 7 aa, synthetic construct
QDSKRPS

SEQ ID NO: 3745 - protein, 7 aa, synthetic construct
DVSKRPS

SEQ ID NO: 3746 - protein, 7 aa, synthetic construct
DVSKRPS

SEQ ID NO: 3747 - protein, 7 aa, synthetic construct
EVSNRPS

SEQ ID NO: 3748 - protein, 7 aa, synthetic construct
RDSNRPS

SEQ ID NO: 3749 - protein, 7 aa, synthetic construct
EVSNRPS

SEQ ID NO: 3750 - protein, 7 aa, synthetic construct
EDSKRPS

SEQ ID NO: 3751 - protein, 7 aa, synthetic construct
EVSKRPS

SEQ ID NO: 3752 - protein, 11 aa, synthetic construct
VKSDGSHSKGD

SEQ ID NO: 3753 - protein, 7 aa, synthetic construct
YDSDRPS

SEQ ID NO: 3754 - protein, 7 aa, synthetic construct
QDSKRPS

SEQ ID NO: 3755 - protein, 7 aa, synthetic construct
QDSKRPS

SEQ ID NO: 3756 - protein, 7 aa, synthetic construct
RDSNRPS

SEQ ID NO: 3757 - protein, 7 aa, synthetic construct
KDSERPS

SEQ ID NO: 3758 - protein, 7 aa, synthetic construct
EDSKRPS

SEQ ID NO: 3759 - protein, 7 aa, synthetic construct
DTSNKHS

SEQ ID NO: 3760 - protein, 7 aa, synthetic construct
EVSNRPS

SEQ ID NO: 3761 - protein, 7 aa, synthetic construct
EVSKRPS

SEQ ID NO: 3762 - protein, 7 aa, synthetic construct
GNSNRPS

SEQ ID NO: 3763 - protein, 7 aa, synthetic construct
DVSKRPS

SEQ ID NO: 3764 - protein, 7 aa, synthetic construct
FDSDRPS

SEQ ID NO: 3765 - protein, 7 aa, synthetic construct
EVSNRPS

SEQ ID NO: 3766 - protein, 7 aa, synthetic construct
EDSKRPS

SEQ ID NO: 3767 - protein, 7 aa, synthetic construct
KDSERPS

SEQ ID NO: 3768 - protein, 7 aa, synthetic construct
KDSERPS

SEQ ID NO: 3769 - protein, 7 aa, synthetic construct
KDSERPS

SEQ ID NO: 3770 - protein, 7 aa, synthetic construct
EDSKRPS

SEQ ID NO: 3771 - protein, 7 aa, synthetic construct
EVSNRPS

SEQ ID NO: 3772 - protein, 7 aa, synthetic construct
EVSNRPS

SEQ ID NO: 3773 - protein, 7 aa, synthetic construct
EDSKRPS

SEQ ID NO: 3774 - protein, 7 aa, synthetic construct
GVSNRPS

SEQ ID NO: 3775 - protein, 11 aa, synthetic construct
YKSDSDKQQGS

SEQ ID NO: 3776 - protein, 7 aa, synthetic construct
KDSERPS

SEQ ID NO: 3777 - protein, 7 aa, synthetic construct
KDSERPS

SEQ ID NO: 3778 - protein, 7 aa, synthetic construct
EDSKRPS

SEQ ID NO: 3779 - protein, 7 aa, synthetic construct
EDSKRPS

SEQ ID NO: 3780 - protein, 7 aa, synthetic construct
GKNNRPS

SEQ ID NO: 3781 - protein, 7 aa, synthetic construct
GKNNRPS

SEQ ID NO: 3782 - protein, 7 aa, synthetic construct
EDSKRPS

SEQ ID NO: 3783 - protein, 7 aa, synthetic construct
EDSKRPS

SEQ ID NO: 3784 - protein, 7 aa, synthetic construct
DVIKRPS

SEQ ID NO: 3785 - protein, 7 aa, synthetic construct
EVSKRPS

SEQ ID NO: 3786 - protein, 7 aa, synthetic construct
EVIYRPS

SEQ ID NO: 3787 - protein, 7 aa, synthetic construct
GNSNRPS

SEQ ID NO: 3788 - protein, 7 aa, synthetic construct
DVSKRPS

SEQ ID NO: 3789 - protein, 7 aa, synthetic construct
DVSKRPS

SEQ ID NO: 3790 - protein, 7 aa, synthetic construct
GKNNRPS

SEQ ID NO: 3791 - protein, 7 aa, synthetic construct
KDSERPS

SEQ ID NO: 3792 - protein, 7 aa, synthetic construct
EVSHRPS

SEQ ID NO: 3793 - protein, 7 aa, synthetic construct
EVSNRPS

SEQ ID NO: 3794 - protein, 7 aa, synthetic construct
DVTTRPS

SEQ ID NO: 3795 - protein, 7 aa, synthetic construct
EVSNRPS

SEQ ID NO: 3796 - protein, 7 aa, synthetic construct
EVSNRPS

SEQ ID NO: 3797 - protein, 7 aa, synthetic construct
EVSKRPS

SEQ ID NO: 3798 - protein, 7 aa, synthetic construct
EVSKRPS

SEQ ID NO: 3799 - protein, 7 aa, synthetic construct
EVSNRPS

SEQ ID NO: 3800 - protein, 7 aa, synthetic construct
QDSKRPS

SEQ ID NO: 3801 - protein, 7 aa, synthetic construct
KDSERPS

SEQ ID NO: 3802 - protein, 7 aa, synthetic construct
EDSKRPS

SEQ ID NO: 3803 - protein, 7 aa, synthetic construct
GKNNRPS

SEQ ID NO: 3804 - protein, 7 aa, synthetic construct
EVSNRPS

SEQ ID NO: 3805 - protein, 7 aa, synthetic construct
GNSNRPS

SEQ ID NO: 3806 - protein, 7 aa, synthetic construct
QDSKRPS

SEQ ID NO: 3807 - protein, 7 aa, synthetic construct
QGSKRPS

SEQ ID NO: 3808 - protein, 7 aa, synthetic construct
GKNNRPS

SEQ ID NO: 3809 - protein, 7 aa, synthetic construct
QDNKRPS

SEQ ID NO: 3810 - protein, 7 aa, synthetic construct
GKNNRPS

SEQ ID NO: 3811 - protein, 7 aa, synthetic construct
GKDNRPS

SEQ ID NO: 3812 - protein, 7 aa, synthetic construct
GKNNRPS

SEQ ID NO: 3813 - protein, 7 aa, synthetic construct
EDSKRPS

SEQ ID NO: 3814 - protein, 7 aa, synthetic construct
EDSKRPS

SEQ ID NO: 3815 - protein, 7 aa, synthetic construct
EDSKRPS

SEQ ID NO: 3816 - protein, 7 aa, synthetic construct
EDIKRPS

SEQ ID NO: 3817 - protein, 7 aa, synthetic construct
DVSKRPS

SEQ ID NO: 3818 - protein, 7 aa, synthetic construct
DVSKRPS

SEQ ID NO: 3819 - protein, 7 aa, synthetic construct
EVSKRPS

SEQ ID NO: 3820 - protein, 7 aa, synthetic construct
EVSNRPS

SEQ ID NO: 3821 - protein, 7 aa, synthetic construct
QDSKRPS

SEQ ID NO: 3822 - protein, 7 aa, synthetic construct
QDSKRPS

SEQ ID NO: 3823 - protein, 7 aa, synthetic construct
KDSERPS

SEQ ID NO: 3824 - protein, 7 aa, synthetic construct
EDSERPS

SEQ ID NO: 3825 - protein, 7 aa, synthetic construct
EDSKRPS

SEQ ID NO: 3826 - protein, 7 aa, synthetic construct
EDSKRPS

SEQ ID NO: 3827 - protein, 7 aa, synthetic construct
GKNNRPS

SEQ ID NO: 3828 - protein, 7 aa, synthetic construct
GKNNRPS

SEQ ID NO: 3829 - protein, 7 aa, synthetic construct
GKNNRPS

SEQ ID NO: 3830 - protein, 7 aa, synthetic construct
EDSKRPS

SEQ ID NO: 3831 - protein, 7 aa, synthetic construct
GKNNRPS

SEQ ID NO: 3832 - protein, 7 aa, synthetic construct
GKNNRPS

SEQ ID NO: 3833 - protein, 7 aa, synthetic construct
GKNNRPS

SEQ ID NO: 3834 - protein, 7 aa, synthetic construct
GQNNRPS

SEQ ID NO: 3835 - protein, 7 aa, synthetic construct
GKNNRPS

SEQ ID NO: 3836 - protein, 7 aa, synthetic construct
HDDLLPS

SEQ ID NO: 3837 - protein, 7 aa, synthetic construct
DVSKRPS

SEQ ID NO: 3838 - protein, 7 aa, synthetic construct
DNSDRPS

SEQ ID NO: 3839 - protein, 7 aa, synthetic construct
GNSNRPS

SEQ ID NO: 3840 - protein, 7 aa, synthetic construct
GNSNRPS

SEQ ID NO: 3841 - protein, 11 aa, synthetic construct
YKSDSDKHQDS

SEQ ID NO: 3842 - protein, 11 aa, synthetic construct
YKSDSDKQQGS

SEQ ID NO: 3843 - protein, 7 aa, synthetic construct
QDRKRPS

SEQ ID NO: 3844 - protein, 7 aa, synthetic construct
EDSKRPS

SEQ ID NO: 3845 - protein, 7 aa, synthetic construct
GKNNRPS

SEQ ID NO: 3846 - protein, 7 aa, synthetic construct
QDSKRPS

SEQ ID NO: 3847 - protein, 7 aa, synthetic construct
GKNNRPS

SEQ ID NO: 3848 - protein, 7 aa, synthetic construct
EDSKRPS

SEQ ID NO: 3849 - protein, 7 aa, synthetic construct
EDSKRPS

SEQ ID NO: 3850 - protein, 7 aa, synthetic construct
EDSKRPS

SEQ ID NO: 3851 - protein, 7 aa, synthetic construct
GNSNRPS

SEQ ID NO: 3852 - protein, 11 aa, synthetic construct
YKSDSDKQQGS

SEQ ID NO: 3853 - protein, 7 aa, synthetic construct
QDSKRPS

SEQ ID NO: 3854 - protein, 7 aa, synthetic construct
GKNNRPS

SEQ ID NO: 3855 - protein, 7 aa, synthetic construct
EDSKRPS

SEQ ID NO: 3856 - protein, 7 aa, synthetic construct
EDSKRPS

SEQ ID NO: 3857 - protein, 7 aa, synthetic construct
YNRDRPS

SEQ ID NO: 3858 - protein, 7 aa, synthetic construct
SNNQRPS

SEQ ID NO: 3859 - protein, 7 aa, synthetic construct
EVSKRPS

SEQ ID NO: 3860 - protein, 7 aa, synthetic construct
EVSKRPS

SEQ ID NO: 3861 - protein, 7 aa, synthetic construct
QDNKRPS

SEQ ID NO: 3862 - protein, 7 aa, synthetic construct
QDIKRPS

SEQ ID NO: 3863 - protein, 7 aa, synthetic construct
QDSMRPS

SEQ ID NO: 3864 - protein, 7 aa, synthetic construct
QDSKRPS

SEQ ID NO: 3865 - protein, 7 aa, synthetic construct
EDSKRPS

SEQ ID NO: 3866 - protein, 7 aa, synthetic construct
EDSKRPS

SEQ ID NO: 3867 - protein, 7 aa, synthetic construct
FNNQRPS

SEQ ID NO: 3868 - protein, 7 aa, synthetic construct
STSNKHS

SEQ ID NO: 3869 - protein, 7 aa, synthetic construct
DVSKRPS

SEQ ID NO: 3870 - protein, 7 aa, synthetic construct
TDCERPS

SEQ ID NO: 3871 - protein, 7 aa, synthetic construct
GKNNRPS

SEQ ID NO: 3872 - protein, 7 aa, synthetic construct
EDSKRPS

SEQ ID NO: 3873 - protein, 7 aa, synthetic construct
EVSKRPS

SEQ ID NO: 3874 - protein, 7 aa, synthetic construct
SSNQRPS

SEQ ID NO: 3875 - protein, 7 aa, synthetic construct
RDSDRPS

SEQ ID NO: 3876 - protein, 7 aa, synthetic construct
GKNNRPS

SEQ ID NO: 3877 - protein, 7 aa, synthetic construct
EDSKRPS

SEQ ID NO: 3878 - protein, 7 aa, synthetic construct
DVSKRPS

SEQ ID NO: 3879 - protein, 7 aa, synthetic construct
DVSKRPS

SEQ ID NO: 3880 - protein, 20 aa, synthetic construct
  VARIANT 3..20: note = GS repeats may be deleted
GSGSGSGSGSGSGSGSGSGS

SEQ ID NO: 3881 - protein, 30 aa, synthetic construct
  VARIANT 4..30: note = GGS repeats may be deleted
GGSGGSGGSGGSGGSGGSGGSGGSGGSGGS

SEQ ID NO: 3882 - protein, 40 aa, synthetic construct
  VARIANT 5..40: note = GGGS repeats may be deleted
GGGSGGGSGGGSGGGSGGGSGGGSGGGSGGGSGGGSGGGS

SEQ ID NO: 3883 - protein, 40 aa, synthetic construct
  VARIANT 5..40: note = GGSG repeats may be deleted
GGSGGGSGGGSGGGSGGGSGGGSGGGSGGGSGGGSGGGSG

SEQ ID NO: 3884 - protein, 50 aa, synthetic construct
  VARIANT 6..50: note = GGSGG repeats may be deleted
GGSGGGGSGGGGSGGGGSGGGGSGGGGSGGGGSGGGGSGGGGSGGGGSGG

SEQ ID NO: 3885 - protein, 50 aa, synthetic construct
  VARIANT 6..50: note = GGGGS repeats may be deleted
GGGGSGGGGSGGGGSGGGGSGGGGSGGGGSGGGGSGGGGSGGGGSGGGGS

SEQ ID NO: 3886 - protein, 15 aa, synthetic construct
GGGGSGGGGSGGGGS

SEQ ID NO: 3887 - protein, 20 aa, synthetic construct
GGGGSGGGGSGGGGSGGGGS

SEQ ID NO: 3888 - RNA, 579 nt, Homo sapiens
  source 1..579: mol_type = mRNA
atgggggtgcacgaatgtcctgcctggctgtggcttctcctgtccctgctgtcgctccctctgggcctcccagtcctgggcgccccaccacgcctcatctgtgacagccgagtcctggagaggtacctcttggaggccaaggaggccgagaatatcacgacgggctgtgctgaacactgcagcttgaatgagaatatcactgtcccagacaccaaagttaatttctatgcctggaagaggatggaggtcgggcagcaggccgtagaagtctggcagggcctggccctgctgtcggaagctgtcctgcggggccaggccctgttggtcaactcttcccagccgtgggagcccctgcagctgcatgtggataaagccgtcagtggccttcgcagcctcaccactctgcttcgggctctgggagcccagaaggaagccatctcccctccagatgcggcctcagctgctccactccgaacaatcactgctgacactttccgcaaactcttccgagtctactccaatttcctccggggaaagctgaagctgtacacaggggaggcctgcaggacaggggacaga

SEQ ID NO: 3889 - protein, 193 aa, Homo sapiens
MGVHECPAWLWLLLSLLSLPLGLPVLGAPPRLICDSRVLERYLLEAKEAENITTGCAEHCSLNENITVPDTKVNFYAWKRMEVGQQAVEVWQGLALLSEAVLRGQALLVNSSQPWEPLQLHVDKAVSGLRSLTTLLRALGAQKEAISPPDAASAAPLRTITADTFRKLFRVYSNFLRGKLKLYTGEACRTGDR

What is claimed is:

1. An antibody or an antigen binding fragment thereof, wherein said antibody or said antigen binding fragment thereof comprises:

(i) a VH complementarity determining region 1 (VH-CDR1), a VH-CDR2, and VH-CDR3 from SEQ ID NO: 1876 and a VL complementarity determining region 1 (VL-CDR1), a VL-CDR2, and a VL-CDR3 from SEQ ID NO: 1957, wherein said VL-CDR1, said VL-CDR2, said VL-CDR3, said VH-CDR1, said VH-CDR2, and said VH-CDR3 are defined according to Kabat, Chothia, IMGT, or AbM;

(ii) a VH-CDR1 comprising an amino acid sequence set forth in SEQ ID NO: 3342, a VH-CDR2 comprising an amino acid sequence set forth in SEQ ID NO: 3478, a VH-CDR3 comprising an amino acid sequence set forth in SEQ ID NO: 1337, a VL-CDR1 comprising an amino acid sequence set forth in SEQ ID NO: 3614, a VL-CDR2 comprising an amino acid sequence set forth in SEQ ID NO: 3750, and a VL-CDR3 comprising an amino acid sequence set forth in SEQ ID NO: 1473;

(iii) a VH-CDR1 comprising an amino acid sequence set forth in SEQ ID NO: 3403, a VH-CDR2 comprising an amino acid sequence set forth in SEQ ID NO: 3539, a VH-CDR3 comprising an amino acid sequence set forth in SEQ ID NO: 1398, a VL-CDR1 comprising an amino acid sequence set forth in SEQ ID NO: 3675, a VL-CDR2 comprising an amino acid sequence set forth in SEQ ID NO: 3811, and a VL-CDR3 comprising an amino acid sequence set forth in SEQ ID NO: 1534;

(iv) a VH-CDR1 comprising an amino acid sequence set forth in SEQ ID NO: 2144, a VH-CDR2 comprising an amino acid sequence set forth in SEQ ID NO: 2332, a VH-CDR3 comprising an amino acid sequence set forth in SEQ ID NO: 139, a VL-CDR1 comprising an amino acid sequence set forth in SEQ ID NO: 2520, a VL-CDR2 comprising an amino acid sequence set forth in SEQ ID NO: 2708, and a VL-CDR3 comprising an amino acid sequence set forth in SEQ ID NO: 327, (v) a VH-CDR1 comprising an amino acid sequence set forth in SEQ ID NO: 3420, a VH-CDR2 comprising an amino acid sequence set forth in SEQ ID NO: 3556, a VH-CDR3 comprising an amino acid sequence set forth in SEQ ID NO: 1415, a VL-CDR1 comprising an amino acid sequence set forth in SEQ ID NO: 3692, a VL-CDR2 comprising an amino acid sequence set forth in SEQ ID NO: 3828, and a VL-CDR3 comprising an amino acid sequence set forth in SEQ ID NO: 1551; or (vi) a VH-CDR1 comprising an amino acid sequence set forth in SEQ ID NO: 3425, a VH-CDR2 comprising an amino acid sequence set forth in SEQ ID NO: 3561, a VH-CDR3 comprising an amino acid sequence set forth in SEQ ID NO: 1420, a VL-CDR1 comprising an amino acid sequence set forth in SEQ ID NO: 3697, a VL-CDR2 comprising an amino acid sequence set forth in SEQ ID NO: 3833, and a VL-CDR3 comprising an amino acid sequence set forth in SEQ ID NO: 1556.

2. The antibody or an antigen binding fragment thereof of claim 1,
wherein said antibody or said antigen binding fragment thereof comprises:
(i) a VH-CDR1, a VH-CDR2, and VH-CDR3 from SEQ ID NO: 1876 and a VL-CDR1, a VL-CDR2, and a VL-CDR3 from SEQ ID NO: 1957, wherein said VH-CDR1, said VH-CDR2, said VH-CDR3, said VL-CDR1, said VL-CDR2, and said VL-CDR3 are defined according to Kabat, Chothia, IMGT, or AbM, and wherein the VH comprises an amino acid sequence at least 80% identical to that set forth in SEQ ID NO: 1876 and the VL comprises an amino acid sequence at least 80% identical to that set forth in SEQ ID NO: 1957;

(ii) a VH-CDR1 comprising an amino acid sequence set forth in SEQ ID NO: 3342, a VH-CDR2 comprising an amino acid sequence set forth in SEQ ID NO: 3478, a VH-CDR3 comprising an amino acid sequence set forth in SEQ ID NO: 1337, a VL-CDR1 comprising an amino acid sequence set forth in SEQ ID NO: 3614, a VL-CDR2 comprising an amino acid sequence set forth in SEQ ID NO: 3750, and a VL-CDR3 comprising an amino acid sequence set forth in SEQ ID NO: 1473, and wherein the VH comprises an amino acid sequence at least 80% identical to that set forth in SEQ ID NO: 1609 and the VL comprises an amino acid sequence at least 80% identical to that set forth in SEQ ID NO: 1745;

(iii) a VH-CDR1 comprising an amino acid sequence set forth in SEQ ID NO: 3403, a VH-CDR2 comprising an amino acid sequence set forth in SEQ ID NO: 3539, a VH-CDR3 comprising an amino acid sequence set forth in SEQ ID NO: 1398, a VL-CDR1 comprising an amino acid sequence set forth in SEQ ID NO: 3675, a VL-CDR2 comprising an amino acid sequence set forth in SEQ ID NO: 3811, and a VL-CDR3 comprising an amino acid sequence set forth in SEQ ID NO: 1534, and wherein the VH comprises an amino acid sequence at least 80% identical to that set forth in SEQ ID NO: 1670 and the VL comprises an amino acid sequence at least 80% identical to that set forth in SEQ ID NO: 1806;

(iv) a VH-CDR1 comprising an amino acid sequence set forth in SEQ ID NO: 2144, a VH-CDR2 comprising an amino acid sequence set forth in SEQ ID NO: 2332, a VH-CDR3 comprising an amino acid sequence set forth in SEQ ID NO: 139, a VL-CDR1 comprising an amino acid sequence set forth in SEQ ID NO: 2520, a VL-CDR2 comprising an amino acid sequence set forth in SEQ ID NO: 2708, and a VL-CDR3 comprising an amino acid sequence set forth in SEQ ID NO: 327, and wherein the VH comprises an amino acid sequence at least 80% identical to that set forth in SEQ ID NO: 515 and the VL comprises an amino acid sequence at least 80% identical to that set forth in SEQ ID NO: 703;

(v) a VH-CDR1 comprising an amino acid sequence set forth in SEQ ID NO: 3420, a VH-CDR2 comprising an amino acid sequence set forth in SEQ ID NO: 3556, a VH-CDR3 comprising an amino acid sequence set forth in SEQ ID NO: 1415, a VL-CDR1 comprising an amino acid sequence set forth in SEQ ID NO: 3692, a VL-CDR2 comprising an amino acid sequence set forth in SEQ ID NO: 3828, and a VL-CDR3 comprising an amino acid sequence set forth in SEQ ID NO: 1551, and wherein the VH comprises an amino acid sequence at least 80% identical to that set forth in SEQ ID NO: 1687 and the VL comprises an amino acid sequence at least 80% identical to that set forth in SEQ ID NO: 1823; or (vi) a VH-CDR1 comprising an amino acid sequence set forth in SEQ ID NO: 3425, a VH-CDR2 comprising an amino acid sequence set forth in SEQ ID NO: 3561, a VH-CDR3 comprising an amino acid sequence set forth in SEQ ID NO: 1420, a VL-CDR1 comprising an amino acid sequence set forth in SEQ ID NO: 3697, a VL-CDR2 comprising an amino acid sequence set forth in SEQ ID NO: 3833, and a VL-CDR3 comprising an amino acid sequence set forth in SEQ ID NO: 1556, and wherein the VH comprises an amino acid sequence at least 80% identical to that set forth in SEQ ID NO: 1692 and the VL comprises an amino acid sequence at least 80% identical to that set forth in SEQ ID NO: 1828.

3. A method of increasing an immune response to a cancer of a subject in need thereof, the method comprising administering to said subject in need thereof a composition comprising an antibody or an antigen binding fragment thereof, wherein said antibody or said antigen binding fragment thereof inhibits erythropoietin receptor activation, and wherein said antibody or said antigen binding fragment thereof comprises:

(i) a VH complementarity determining region 1 (VH-CDR1), a VH-CDR2, and VH-CDR3 from SEQ ID NO: 1876 and a VL complementarity determining region 1 (VL-CDR1), a VL-CDR2, and a VL-CDR3 from SEQ ID NO: 1957, wherein said VL-CDR1, said VL-CDR2, said VL-CDR3, said VH-CDR1, said VH-CDR2, and said VH-CDR3 are defined according to Kabat, Chothia, IMGT, or AbM;

(ii) a VH-CDR1 comprising an amino acid sequence set forth in SEQ ID NO: 3342, a VH-CDR2 comprising an amino acid sequence set forth in SEQ ID NO: 3478, a VH-CDR3 comprising an amino acid sequence set forth in SEQ ID NO: 1337, a VL-CDR1 comprising an amino acid sequence set forth in SEQ ID NO: 3614, a VL-CDR2 comprising an amino acid sequence set forth in SEQ ID NO: 3750, and a VL-CDR3 comprising an amino acid sequence set forth in SEQ ID NO: 1473;

(iii) a VH-CDR1 comprising an amino acid sequence set forth in SEQ ID NO: 3403, a VH-CDR2 comprising an amino acid sequence set forth in SEQ ID NO: 3539, a VH-CDR3 comprising an amino acid sequence set forth in SEQ ID NO: 1398, a VL-CDR1 comprising an amino acid sequence set forth in SEQ ID NO: 3675, a VL-CDR2 comprising an amino acid sequence set forth in SEQ ID NO: 3811, and a VL-CDR3 comprising an amino acid sequence set forth in SEQ ID NO: 1534;

(iv) a VH-CDR1 comprising an amino acid sequence set forth in SEQ ID NO: 2144, a VH-CDR2 comprising an amino acid sequence set forth in SEQ ID NO: 2332, a VH-CDR3 comprising an amino acid sequence set forth in SEQ ID NO: 139, a VL-CDR1 comprising an amino acid sequence set forth in SEQ ID NO: 2520, a VL-CDR2 comprising an amino acid sequence set forth in SEQ ID NO: 2708, and a VL-CDR3 comprising an amino acid sequence set forth in SEQ ID NO: 327, (v) a VH-CDR1 comprising an amino acid sequence set forth in SEQ ID NO: 3420, a VH-CDR2 comprising an amino acid sequence set forth in SEQ ID NO: 3556, a VH-CDR3 comprising an amino acid sequence set forth in SEQ ID NO: 1415, a VL-CDR1 comprising an amino acid sequence set forth in SEQ ID NO: 3692, a VL-CDR2 comprising an amino acid sequence set forth in SEQ ID NO: 3828, and a VL-CDR3 comprising an amino acid sequence set forth in SEQ ID NO: 1551; or (vi) a VH-CDR1 comprising an amino acid sequence set forth in SEQ ID NO: 3425, a VH-CDR2 comprising an amino acid sequence set forth in SEQ ID NO: 3561, a VH-CDR3 comprising an amino acid sequence set forth in SEQ ID NO: 1420, a VL-CDR1 comprising an amino acid sequence set forth in SEQ ID NO: 3697, a VL-CDR2 comprising an amino acid sequence set forth in SEQ ID NO: 3833, and a VL-CDR3 comprising an amino acid sequence set forth in SEQ ID NO: 1556.

4. The method of claim 3, wherein said antibody or said antigen binding fragment thereof comprises a VH-CDR1, a VH-CDR2, and VH-CDR3 from SEQ ID NO: 1876 and a VL-CDR1, a VL-CDR2, and a VL-CDR3 from SEQ ID NO: 1957, wherein said VH-CDR1, said VH-CDR2, said VH-CDR3, said VL-CDR1, said VL-CDR2, and said VL-CDR3 are defined according to Kabat, Chothia, IMGT, or AbM.

5. The method of claim 4, wherein said antibody or said antigen binding fragment thereof comprises a VL comprising an amino acid sequence at least 80% identical to that set forth in SEQ ID NO: 1957 and a VH comprising an amino acid sequence at least 80% identical to that set forth in SEQ ID NO: 1876.

6. The method of claim 3, wherein said antibody or said antigen binding fragment thereof comprises a VH-CDR1 comprising an amino acid sequence set forth in SEQ ID NO: 3342, a VH-CDR2 comprising an amino acid sequence set forth in SEQ ID NO: 3478, a VH-CDR3 comprising an amino acid sequence set forth in SEQ ID NO: 1337, a VL-CDR1 comprising an amino acid sequence set forth in SEQ ID NO: 3614, a VL-CDR2 comprising an amino acid sequence set forth in SEQ ID NO: 3750, and a VL-CDR3 comprising an amino acid sequence set forth in SEQ ID NO: 1473.

7. The method of claim 6, wherein said antibody or said antigen binding fragment thereof comprises a VL comprising an amino acid sequence at least 80% identical to that set forth in SEQ ID NO: 1745 and a VH comprising an amino acid sequence at least 80% identical to that set forth in SEQ ID NO: 1609.

8. The method of claim 3, wherein said antibody or said antigen binding fragment thereof comprises a VH-CDR1 comprising an amino acid sequence set forth in SEQ ID NO: 3403, a VH-CDR2 comprising an amino acid sequence set forth in SEQ ID NO: 3539, a VH-CDR3 comprising an amino acid sequence set forth in SEQ ID NO: 1398, a VL-CDR1 comprising an amino acid sequence set forth in SEQ ID NO: 3675, a VL-CDR2 comprising an amino acid sequence set forth in SEQ ID NO: 3811, and a VL-CDR3 comprising an amino acid sequence set forth in SEQ ID NO: 1534.

9. The method of claim 8, wherein said antibody or said antigen binding fragment thereof comprises a VL comprising an amino acid sequence at least 80% identical to that set forth in SEQ ID NO: 1806 and a VH comprising an amino acid sequence at least 80% identical to that set forth in SEQ ID NO: 1670.

10. The method of claim 3, wherein said antibody or said antigen binding fragment thereof comprises a VH-CDR1 comprising an amino acid sequence set forth in SEQ ID NO: 3420, a VH-CDR2 comprising an amino acid sequence set forth in SEQ ID NO: 3556, a VH-CDR3 comprising an amino acid sequence set forth in SEQ ID NO: 1415, a VL-CDR1 comprising an amino acid sequence set forth in SEQ ID NO: 3692, a VL-CDR2 comprising an amino acid sequence set forth in SEQ ID NO: 3828, and a VL-CDR3 comprising an amino acid sequence set forth in SEQ ID NO: 1551.

11. The method of claim 10, wherein said antibody or said antigen binding fragment thereof comprises a VL comprising an amino acid sequence at least 80% identical to that set forth in SEQ ID NO: 1823 and a VH comprising an amino acid sequence at least 80% identical to that set forth in SEQ ID NO: 1687.

12. The method of claim 3, wherein said antibody or said antigen binding fragment thereof comprises a VH-CDR1 comprising an amino acid sequence set forth in SEQ ID NO: 2144, a VH-CDR2 comprising an amino acid sequence set forth in SEQ ID NO: 2332, a VH-CDR3 comprising an amino acid sequence set forth in SEQ ID NO: 139, a VL-CDR1 comprising an amino acid sequence set forth in SEQ ID NO: 2520, a VL-CDR2 comprising an amino acid sequence set forth in SEQ ID NO: 2708, and a VL-CDR3 comprising an amino acid sequence set forth in SEQ ID NO: 327.

13. The method of claim 12, wherein said antibody or said antigen binding fragment thereof comprises a VL comprising an amino acid sequence at least 80% identical to that set forth in SEQ ID NO: 703 and a VH comprising an amino acid sequence at least 80% identical to that set forth in SEQ ID NO: 515.

14. The method of claim 3, wherein said antibody or said antigen binding fragment thereof comprises a VH-CDR1 comprising an amino acid sequence set forth in SEQ ID NO: 3425, a VH-CDR2 comprising an amino acid sequence set forth in SEQ ID NO: 3561, a VH-CDR3 comprising an amino acid sequence set forth in SEQ ID NO: 1420, a VL-CDR1 comprising an amino acid sequence set forth in SEQ ID NO: 3697, a VL-CDR2 comprising an amino acid sequence set forth in SEQ ID NO: 3833, and a VL-CDR3 comprising an amino acid sequence set forth in SEQ ID NO: 1556.

15. The method of claim 14, wherein said antibody or said antigen binding fragment thereof comprises a VL comprising an amino acid sequence at least 80% identical to that set forth in SEQ ID NO: 1828 and a VH comprising an amino acid sequence at least 80% identical to that set forth in SEQ ID NO: 1692.

16. The method of claim 3, wherein said antibody or said antigen binding fragment thereof binds to an erythropoietin receptor with a dissociation constant (Kd) of from $1 \times 10^{-12}$ M to $5 \times 10^{-7}$ M, wherein said Kd is measured by surface plasmon resonance, a biosensor system for measuring binding affinity, scintillation proximity assays, enzyme linked immunosorbent assay (ELISA), fluidic-free biolayer interferometry (BLI) assay, ORIGEN immunoassay (IGEN), fluorescence quenching, fluorescence transfer, yeast display, or any combination thereof.

17. The method of claim 3, wherein said cancer is resistant to immune checkpoint inhibitor therapy.

18. The method of claim 3, further comprising administering one or more immune checkpoint inhibitors to said patient.

19. The method of claim 18, wherein said one or more immune checkpoint inhibitors comprise a Cytotoxic T-Lymphocyte Associated Protein 4 (CTLA-4) inhibitor comprising an anti-CTLA-4 antibody, a Programmed Death I (PD-1) inhibitor comprising an anti-PD-1 antibody, or a Programmed Death Ligand 1 (PD-L1) inhibitor comprising an anti-PD-L1 antibody.

20. The method of claim 18, wherein said one or more immune checkpoint inhibitors comprise nivolumab, pembrolizumab, cemiplimab, atezolizumab, avelumab, durvalumab, ipilimumab, lirilumab, or BMS-986016.

21. The method of claim 3, wherein said antibody or said antigen binding fragment thereof is a bispecific antibody comprising a second antigen binding domain that binds to a signaling molecule associated with immune cells.

22. The method of claim 21, wherein said signaling molecule associated with immune cells is PD-L1, TIM3 or TREM2.

23. The method of claim 3, wherein said antibody or said antigen binding domain is a bispecific antibody comprising a second antigen binding domain that binds to an antigen associated with said cancer.

24. The method of claim 3, wherein the method treats said cancer.

25. The method of claim 24, wherein said cancer is selected from the group consisting of a lung cancer, a breast cancer, a colon cancer, a brain cancer, a skin cancer, a colorectal cancer, a liver cancer, and a lymph node metastasis.

26. The method of claim 24, wherein said cancer is selected from the group consisting of a melanoma, a hepatocarcinoma, and a liver metastasis.

27. A method of treating cancer in a patient in need thereof, the method comprising administering to said patient an antibody or an antigen binding fragment thereof;
wherein said antibody or said antigen binding fragment thereof comprises:
(i) a VH complementarity determining region 1 (VH-CDR1), a VH-CDR2, and VH-CDR3 from SEQ ID NO: 1876 and a VL complementarity determining region 1 (VL-CDR1), a VL-CDR2, and a VL-CDR3 from SEQ ID NO: 1957, wherein said VL-CDR1, said VL-CDR2, said VL-CDR3, said VH-CDR1, said VH-CDR2, and said VH-CDR3 are defined according to Kabat, Chothia, IMGT, or AbM;
(ii) a VH-CDR1 comprising an amino acid sequence set forth in SEQ ID NO: 3342, a VH-CDR2 comprising an amino acid sequence set forth in SEQ ID NO: 3478, a VH-CDR3 comprising an amino acid sequence set forth in SEQ ID NO: 1337, a VL-CDR1 comprising an amino acid sequence set forth in SEQ ID NO: 3614, a VL-CDR2 comprising an amino acid sequence set forth in SEQ ID NO: 3750, and a VL-CDR3 comprising an amino acid sequence set forth in SEQ ID NO: 1473;
(iii) a VH-CDR1 comprising an amino acid sequence set forth in SEQ ID NO: 3403, a VH-CDR2 comprising an amino acid sequence set forth in SEQ ID NO: 3539, a VH-CDR3 comprising an amino acid sequence set forth in SEQ ID NO: 1398, a VL-CDR1 comprising an amino acid sequence set forth in SEQ ID NO: 3675, a VL-CDR2 comprising an amino acid sequence set forth in SEQ ID NO: 3811, and a VL-CDR3 comprising an amino acid sequence set forth in SEQ ID NO: 1534;
(iv) a VH-CDR1 comprising an amino acid sequence set forth in SEQ ID NO: 2144, a VH-CDR2 comprising an amino acid sequence set forth in SEQ ID NO: 2332, a VH-CDR3 comprising an amino acid sequence set forth in SEQ ID NO: 139, a VL-CDR1 comprising an amino acid sequence set forth in SEQ ID NO: 2520, a VL-CDR2 comprising an amino acid sequence set forth in SEQ ID NO: 2708, and a VL-CDR3 comprising an amino acid sequence set forth in SEQ ID NO: 327,
(v) a VH-CDR1 comprising an amino acid sequence set forth in SEQ ID NO: 3420, a VH-CDR2 comprising an amino acid sequence set forth in SEQ ID NO: 3556, a VH-CDR3 comprising an amino acid sequence set forth in SEQ ID NO: 1415, a VL-CDR1 comprising an amino acid sequence set forth in SEQ ID NO: 3692, a VL-CDR2 comprising an amino acid sequence set forth in SEQ ID NO: 3828, and a VL-CDR3 comprising an amino acid sequence set forth in SEQ ID NO: 1551; or
(vi) a VH-CDR1 comprising an amino acid sequence set forth in SEQ ID NO: 3425, a VH-CDR2 comprising an amino acid sequence set forth in SEQ ID NO: 3561, a VH-CDR3 comprising an amino acid sequence set forth in SEQ ID NO: 1420, a VL-CDR1 comprising an amino acid sequence set forth in SEQ ID NO: 3697, a VL-CDR2 comprising an amino acid sequence set forth in SEQ ID NO: 3833, and a VL-CDR3 comprising an amino acid sequence set forth in SEQ ID NO: 1556.

28. The method of claim 27, wherein said antibody or said antigen binding fragment thereof comprises:
(i) a VH-CDR1, a VH-CDR2, and VH-CDR3 from SEQ ID NO: 1876 and a VL-CDR1, a VL-CDR2, and a VL-CDR3 from SEQ ID NO: 1957, wherein said VH-CDR1, said VH-CDR2, said VH-CDR3, said VL- CDR1, said VL-CDR2, and said VL-CDR3 are defined according to Kabat, Chothia, IMGT, or AbM, and wherein the VH comprises an amino acid sequence at least 80% identical to that set forth in SEQ ID NO: 1876 and the VL comprises an amino acid sequence at least 80% identical to that set forth in SEQ ID NO: 1957;

(ii) a VH-CDR1 comprising an amino acid sequence set forth in SEQ ID NO: 3342, a VH-CDR2 comprising an amino acid sequence set forth in SEQ ID NO: 3478, a VH-CDR3 comprising an amino acid sequence set forth in SEQ ID NO: 1337, a VL-CDR1 comprising an amino acid sequence set forth in SEQ ID NO: 3614, a VL-CDR2 comprising an amino acid sequence set forth in SEQ ID NO: 3750, and a VL-CDR3 comprising an amino acid sequence set forth in SEQ ID NO: 1473, and wherein the VH comprises an amino acid sequence at least 80% identical to that set forth in SEQ ID NO: 1609 and the VL comprises an amino acid sequence at least 80% identical to that set forth in SEQ ID NO: 1745;

(iii) a VH-CDR1 comprising an amino acid sequence set forth in SEQ ID NO: 3403, a VH-CDR2 comprising an amino acid sequence set forth in SEQ ID NO: 3539, a VH-CDR3 comprising an amino acid sequence set forth in SEQ ID NO: 1398, a VL-CDR1 comprising an amino acid sequence set forth in SEQ ID NO: 3675, a VL-CDR2 comprising an amino acid sequence set forth in SEQ ID NO: 3811, and a VL-CDR3 comprising an amino acid sequence set forth in SEQ ID NO: 1534, and wherein the VH comprises an amino acid sequence at least 80% identical to that set forth in SEQ ID NO: 1670 and the VL comprises an amino acid sequence at least 80% identical to that set forth in SEQ ID NO: 1806;

(iv) a VH-CDR1 comprising an amino acid sequence set forth in SEQ ID NO: 2144, a VH-CDR2 comprising an amino acid sequence set forth in SEQ ID NO: 2332, a VH-CDR3 comprising an amino acid sequence set forth in SEQ ID NO: 139, a VL-CDR1 comprising an amino acid sequence set forth in SEQ ID NO: 2520, a VL-CDR2 comprising an amino acid sequence set forth in SEQ ID NO: 2708, and a VL-CDR3 comprising an amino acid sequence set forth in SEQ ID NO: 327, and wherein the VH comprises an amino acid sequence at least 80% identical to that set forth in SEQ ID NO: 515 and the VL comprises an amino acid sequence at least 80% identical to that set forth in SEQ ID NO: 703;

(v) a VH-CDR1 comprising an amino acid sequence set forth in SEQ ID NO: 3420, a VH-CDR2 comprising an amino acid sequence set forth in SEQ ID NO: 3556, a VH-CDR3 comprising an amino acid sequence set forth in SEQ ID NO: 1415, a VL-CDR1 comprising an amino acid sequence set forth in SEQ ID NO: 3692, a VL-CDR2 comprising an amino acid sequence set forth in SEQ ID NO: 3828, and a VL-CDR3 comprising an amino acid sequence set forth in SEQ ID NO: 1551, and wherein the VH comprises an amino acid sequence at least 80% identical to that set forth in SEQ ID NO: 1687 and the VL comprises an amino acid sequence at least 80% identical to that set forth in SEQ ID NO: 1823; or (vi) a VH-CDR1 comprising an amino acid sequence set forth in SEQ ID NO: 3425, a VH-CDR2 comprising an amino acid sequence set forth in SEQ ID NO: 3561, a VH-CDR3 comprising an amino acid sequence set forth in SEQ ID NO: 1420, a VL-CDR1 comprising an amino acid sequence set forth in SEQ ID NO: 3697, a VL-CDR2 comprising an amino acid sequence set forth in SEQ ID NO: 3833, and a VL-CDR3 comprising an amino acid sequence set forth in SEQ ID NO: 1556, and wherein the VH comprises an amino acid sequence at least 80% identical to that set forth in SEQ ID NO: 1692 and the VL comprises an amino acid sequence at least 80% identical to that set forth in SEQ ID NO: 1828.

* * * * *